United States Patent
Harper et al.

(10) Patent No.: US 10,196,636 B2
(45) Date of Patent: *Feb. 5, 2019

(54) RECOMBINANT VIRUS PRODUCTS AND METHODS FOR INHIBITION OF EXPRESSION OF MYOTILIN

(71) Applicant: NATIONWIDE CHILDREN'S HOSPITAL, INC., Columbus, OH (US)

(72) Inventors: Scott Quenton Harper, Powell, OH (US); Jian Liu, Los Angeles, CA (US)

(73) Assignee: NATIONWIDE CHILDREN'S HOSPITAL, INC., Columbus, OH (US)

( * ) Notice: Subject to any disclaimer, the term of this patent is extended or adjusted under 35 U.S.C. 154(b) by 474 days.

This patent is subject to a terminal disclaimer.

(21) Appl. No.: 14/853,517

(22) Filed: Sep. 14, 2015

(65) Prior Publication Data

US 2016/0310548 A1 Oct. 27, 2016

Related U.S. Application Data

(63) Continuation-in-part of application No. 14/058,909, filed on Oct. 21, 2013, now Pat. No. 9,133,482, which is a continuation-in-part of application No. PCT/US2012/034408, filed on Apr. 20, 2012.

(60) Provisional application No. 61/478,012, filed on Apr. 21, 2011.

(51) Int. Cl.
*C12N 15/86* (2006.01)
*C12N 15/113* (2010.01)
*C07K 14/47* (2006.01)

(52) U.S. Cl.
CPC ........ *C12N 15/113* (2013.01); *C07K 14/4707* (2013.01); *C12N 15/1138* (2013.01); *C12N 15/86* (2013.01); *C12N 2310/14* (2013.01); *C12N 2310/141* (2013.01); *C12N 2320/32* (2013.01); *C12N 2330/51* (2013.01); *C12N 2750/14143* (2013.01)

(58) Field of Classification Search
None
See application file for complete search history.

(56) References Cited

U.S. PATENT DOCUMENTS

| | | | |
|---|---|---|---|
| 5,173,414 A | 12/1992 | Lebkowski et al. | |
| 5,658,776 A | 8/1997 | Flotte et al. | |
| 5,786,211 A | 7/1998 | Johnson | |
| 5,871,982 A | 2/1999 | Wilson et al. | |
| 6,258,595 B1 | 7/2001 | Gao et al. | |
| 6,566,118 B1 | 5/2003 | Atkinson et al. | |
| 2014/0045925 A1* | 2/2014 | Harper | 15/86 |

FOREIGN PATENT DOCUMENTS

| | | |
|---|---|---|
| WO | WO-1995/013365 A1 | 5/1995 |
| WO | WO-1995/013392 A1 | 5/1995 |
| WO | WO-1996/017947 A1 | 6/1996 |
| WO | WO-1997/006243 A1 | 2/1997 |
| WO | WO-1997/008298 A1 | 3/1997 |
| WO | WO-1997/009441 A2 | 3/1997 |
| WO | WO-1997/021825 A1 | 6/1997 |
| WO | WO-1998/009657 A2 | 3/1998 |
| WO | WO-1999/011764 A2 | 3/1999 |
| WO | WO-2002/053703 A2 | 7/2002 |

OTHER PUBLICATIONS

Carter, Adeno-associated virus vectors. *Curr. Opin. Biotechnol.* 3: 533-9 (1992).
Clark et al., A stable cell line carrying adenovirus-inducible rep and cap genes allows for infectivity titration of adeno-associated virus vectors. *Gene Ther.* 3: 1124-32 (1996).
Clark et al., Highly purified recombinant adeno-associated virus vectors are biologically active and free of detectable helper and wild-type viruses. *Hum. Gene Ther.*, 10(6):1031-9 (1999).
Cserjesi et al., Myogenin induces the myocyte-specific enhancer binding factor MEF-2 independently of other muscle-specific gene products. *Mol. Cell Biol.* 11: 4854-62 (1991).
De et al., High levels of persistent expression of alpha1-antitrypsin mediated by the nonhuman primate serotype rh.10 adeno-associated virus despite preexisting immunity to common human adeno-associated viruses. *Mol. Ther.* 13(1): 67-76 (2006).
Duan (Ed.), Section 7.3 of Chapter 7 in Muscle Gene Therapy, Springer Science Business Media, LLC (2010).
Fechner et al., Cardiac-targeted RNA interference mediated by an AAV9 vector improves cardiac function in coxsackievirus B3 cardiomyopathy. *J. Mol. Med.* 86: 987-97 (2008).
Gao et al., Clades of adeno-associated viruses are widely disseminated in human tissues. *J. Virol.* 78: 6381-8 (2004).
Garvey et al., Patho-Genetic Characterization of the Muscular Dystrophy Gene Myotilin, Duke University, 137-8 (2007).
Garvey et al., Transgenic mice expressing the myotilin T57I mutation unite the pathology associated with LGMD1A and MFM. *Hum. Mol. Genet.*, 15: 2348-62 (2006).
GenBank Accession No. AF085716, Adeno-associated virus 5 DNA binding trs helicase (Rep22) and capsid protein (VP1) genes, dated Feb. 10, 1999.
Genbank Accession No. AX753246, Sequence 1 from Patent EP1310571, dated Jun. 23, 2003.

(Continued)

*Primary Examiner* — Michael D Burkhart
(74) *Attorney, Agent, or Firm* — Marshall, Gerstein & Borun LLP

(57) ABSTRACT

The present invention relates to RNA interference-based methods for inhibiting the expression of the myotilin gene. Recombinant adeno-associated viruses of the invention deliver DNAs encoding microRNAs that knock down the expression of myotilin. The methods have application in the treatment of muscular dystrophies such as Limb Girdle Muscular Dystrophy Type 1A.

20 Claims, 7 Drawing Sheets
(5 of 7 Drawing Sheet(s) Filed in Color)
Specification includes a Sequence Listing.

(56) References Cited

OTHER PUBLICATIONS

Genbank Accession No. AX753249, Sequence 4 from Patent EP1310571, dated Jun. 23, 2003.
GenBank Accession No. NC_001401, Adeno-associated virus—2, complete genome, dated Aug. 1, 2000.
GenBank Accession No. NC_001829, Adeno-associated virus—4, complete genome, dated Aug. 1, 2000.
GenBank Accession No. NC_001862, Adeno-associated virus 6, complete genome, dated Jan. 12, 2004.
GenBank Accession No. NC_002077, Adeno-associated virus—1, complete genome, dated Aug. 1, 2000.
Hauser et al., Myotilin is mutated in limb girdle muscular dystrophy 1A. *Hum. Mol. Genet.* 9: 2141-7 (2000).
Hauser et al., myotilin Mutation found in second pedigree with LGMD1A. *Am. J. Hum. Genet.* 71: 1428-32 (2002).
Hermonat et al., Use of adeno-associated virus as a mammalian DNA cloning vector: Transduction of neomycin resistance into mammalian tissue culture cells. *Proc. Natl. Acad. Sci. USA*, 81: 6466-70 (1984).
Johnson et al., Muscle creatine kinase sequence elements regulating skeletal and cardiac muscle expression in transgenic mice. *Mol. Cell. Biol.* 9: 3393-9 (1989).
Laughlin et al., Cloning of infectious adeno-associated virus genomes in bacterial plasmids. *Gene*, 23: 65-73 (1983).
Lebkowski et al., Adeno-associated virus: a vector system for efficient introduction and integration of DNA into a variety of mammalian cell types. *Mol. Cell. Biol.* 8(10): 3988-96 (1988).
Liu et al., Abstract T.O.1: RNAi therapy for LGMD1A. *Neuromusc. Disorders*, 22: 9-10 (2012).
Liu et al., RNAi-mediated gene silencing of mutant myotilin impromes myopathy in LGMD1A mice. *Molec. Ther. Nucl. Acids*, 3(4): 1-10 (2014).
Liu et al., RNAi-based gene therapy for dominant limb girdle muscular dystrophies. *Curr. Gene. Ther.* 12(4): 304-14 (2012).
Mader et al., A steroid-inducible promoter for the controlled overexpression of cloned genes in eukaryotic cells. *Proc. Natl. Acad. Sci. USA*, 90: 5603-7 (1993).
McCarty, Self-complementary AAV vectors: Advances and applications. *Mol. Ther.* 16(10): 1648-56 (2008).
McLaughlin et al., Adeno-associated virus general transduction vectors: analysis of proviral structures. *J. Virol.* 62: 1963-73 (1988).
Mori et al., Two novel adeno-associated viruses from cynomolgus monkey: pseudotyping characterization of capsid protein. *Virology*, 330(2): 375-83 (2004).
Muscat et al., Multiple 5'-flanking regions of the human alpha-skeletal actin gene synergistically modulate muscle-specific expression. *Mol. Cell Biol.* 7: 4089-99 (1987).
Muzyczka, Use of adeno-associated virus as a general transduction vector for mammalian cells. *Curr. Top. Microbiol. Immunol.* 158: 97-129 (1992).
Paul et al., Increased viral titer through concentration of viral harvests from retroviral packaging lines. *Hum. Gene Ther.* 4: 609-15 (1993).
Perrin et al., An experimental rabies vaccine produced with a new BHK-21 suspension cell culture process: Use of serum-free medium and perfusion-reactor system. *Vaccine*, 13: 1244-50 (1995).
Samulski et al., Cloning of adeno-associated virus into pBR322: rescue of intact virus from the recombinant plasmid in human cells. *Proc. Natl. Acad. Sci. USA*, 79: 2077-81 (1982).
Samulski et al., Helper-free stocks of recombinant adeno-associated viruses: normal integration does not require viral gene expression. *J. Virol.* 63: 3822-8 (1989).
Schnepp et al., Highly purified recombinant adeno-associated virus vectors. Preparation and quantitation. *Methods Mol. Med.* 69: 427-43 (2002).
Semenza et al., Hypoxia-inducible nuclear factors bind to an enhancer element located 3' to the human erythropoietin gene. *Proc. Natl. Acad. Sci. USA*, 88: 5680-4 (1991).
Senapathy et al., Molecular cloning of adeno-associated virus variant genomes and generation of infectious virus by recombination in mammalian cells. *J. Biol. Chem.* 259: 4661-6 (1984).
Shalaby et al., Defective myotilin homodimerization caused by a novel mutation in MYOT exon 9 in the first Japanese limb girdle muscular dystrophy 1A patient. *J. Neuropathol. Exp. Neurol.* 68: 701-7 (2009).
Snyder et al., Efficient and stable adeno-associated virus-mediated transduction in the skeletal muscle of adult immunocompetent mice. *Hum. Gene Ther.* 8(16): 1891-900 (1997).
Srivastava et al., Nucleotide Sequence and organization of the adeno-associated virus 2 genome, *J. Virol.* 45: 555-64 (1983).
Supplemental European Search Report, EP 12774899.4, dated Dec. 10, 2014.
Tang et al., AAV-directed muscular dystrophy gene therapy. *Exp. Opin. Biol. Ther.* 10(3): 395-408 (2010).
Tratschin et al., A human parvovirus, adeno-associated virus, as a eucaryotic vector: Transient expression and encapsidation of the procaryotic gene for chloramphenicol acetyltransferase. *Mol. Cell. Biol.* 4: 2072-81 (1984).
Tratschin et al., Adeno-associated virus vector for high-frequency integration, expression, and rescue of genes in mammalian cells. *Mol. Cell. Biol.* 5: 3251-60 (1985).
Wallace et al., Chapter 7: RNAi Therapy for Dominant Muscular Dystrophis and Other Myopathies. *Mus. Gene Ther.* 99-115 (2010).
Wang et al., Construction and analysis of compact muscle-specific promoters for AAV vectors. *Gene Ther.* 15: 1489-99 (2008).
Weintraub et al., The myoD gene family: nodal point during specification of the muscle cell lineage. *Science*, 251: 761-6 (1991).

\* cited by examiner

Figure 1

Human C450T myotilin sequence (target sites are underlined and highlighted)

GGGAAGGAGATGCCTCTTCCTTCCCTTCAATAGTGGGTTAAACCCAGCTGGCA
CCCTCTGGAACTACGGGAACAATATTCTTCAAGAGAAGGTCACTCTACCAAAG
CCAGGAGCACAGTATTCTCAGGATCTCAACAAGGAAGAGCAGACCAAGGTTGC
TTCTGATTCCTTACAACCTTCCGTAATTCCAGGCTTGTGGCCCCAAATTCAGG
GCCCCACCCTTCCAGGAACAAATCATTATAGTAATAATTTGCCTTCATCTTCC
ATATACCAACTAAGCATGTTTAACTACGAACGTCCAAAACACTTCATCCAGTC
CCAAAACCCATGTGGCTCCAGATTGCAGCCTCCTGGACCAGAAACCTCCAGCT
TCTCTAGCCAGACCAAACAGTCTTCCATTATCATCCAGCCCCGCCAGTGTACA
GAGCAAAGATTTTCTGCCTCCTCAATACTGAGCTCTCACATCACCATGTCCTC
CTCTGCTTTCCCTGCTTCTCCCAAGCAGCATGCTGGCTCCAACCCAGGCCAAA
GGGTTACAACCACCTATAACCAGTCCCCAGCCAGCTTCCTCAGCTCCATATTA
CCATCACA592GCCTGATTACAATAGCAGTAAAATCCCTTCCGCTATGGATTC
CAACTATCAACAGTCCTCAGCTGGCCAACCTATAAATGCAAAGCCATCCCAAA
CTGCAAATGCTAAGCCCATACCAAGAACTCCTGATCATGAAATACAAGGATCA
AAAGAAGCTTTGATTCAAGATTTGGAAAGAAAGCTGAAATGCAAGGACACCCT
TCTTCATAATGGAAATCAACGTCTAACATATGAAGAGAAGATGGCTCGCAGAT
TGCTAGGACCACAGAATGCAGCTGCTGTGTTTCAAGCTCAGGATGACAGTGGT
GCACAAGACTCGCAGCAACACAACTCAGAACATGCGCGACTGCAAGTTCCTAC
ATCACAAGTAAGAAGTAGATCAACCTCAAGGGGAGATGTGAATGATCAGGATG
CAATCCAGGAGAAATTTTACCCACCACGTTTCATTCAAGTGCCAGAGAACATG
TCGATTGATGAAGGAAGATTCTGCAGAATGGACTTCAAAGTGAGTGGACTGCC
AGCTCCTGATGTGTCATGGTATCTAAATGGAAGAACAGTTCAATCAGATGATT
TGCACAAAATGATAGTGTCTGAGAAGGGTCTTCATTCACTCATCTTTGAAGTA
GTCAGAGCTTCAGATGCAGGGGCTTATGCATGTGTTGCCAAGAATAGAGCAGG
AGAAGCCACCTTCACTGTGCA1291GCTGGATGTCCTTGCAAAAGAACATAAA
AG1321AGCACCAATGTTTATCTACAAACCACAGAGCAAAAAGTTTTAGA13
66GGGAGATTCAGTGAAACTAGAATGCCAGATCTCGGCTATACCTCCACCAAA
GCTTTTCTGGAAAAGAAATAATGAAATGGTACAATTCAACACTGACCGAATAA
GCTTATATCAAGATAACACT1490GGAAGAGTTACTTTACTGATAAAAGATGT
AAACAAGAAAGATGCTGGGTGGTATACTGTGTCAGCAGTTAATGAAGCTGGAG
TGACTACATGTAACACAAGATTAGACGTTAC1603GGCACGTCCAAACCAAAC
TCTTCCAGCTCCTAAGCAGTTACGGGTTCGACCAACATTCAGCAAATATTTAG
CACTTAATGGGAAAGGTTTGAATGTAAAACAAGCTTTTAACCCAGAAGGAGAA
TTTCAGCGTTTGGCAGCTCAATCTGGACTCTATGAAAGTGAAGAACTTTAATA
ACTTTACCAACATTGGAAAACAGCCAACTACACCATTAGTAATATATTTGATT
ACATTTTTTGAAATTAATCCATAGCTGTATTAACAGATTATGGTTTTAATTA
GGTAATATAGTTAATATATATTTATAATATTATTTATCCTTTGACTCTTGCAC
ATTCTATGTACCCCTCCGATTTGTGAAGCCTACAGGAAATCTGGGTATATGGA
TTTGTAACTGCAGAAGACTATCTTAAAATACAGGATTTTAACATTTAAGTCAT
GCACATTTAACAATTACAGGTTATAAATTAGTATCAACTTTTTAAACACATCT
AATGCTTGTAATAACGTTTACTGGTACTGCTTTCTAAATACTGTTTTACCCGT
TTTCTCTTGTAGGAATACTAACATGGTATAGATTATCTGAGTGTTCCACAGTT
GTATGTCAAAAGAAAATAAAATTCAAATATTTAAAACGGA

Figure 2
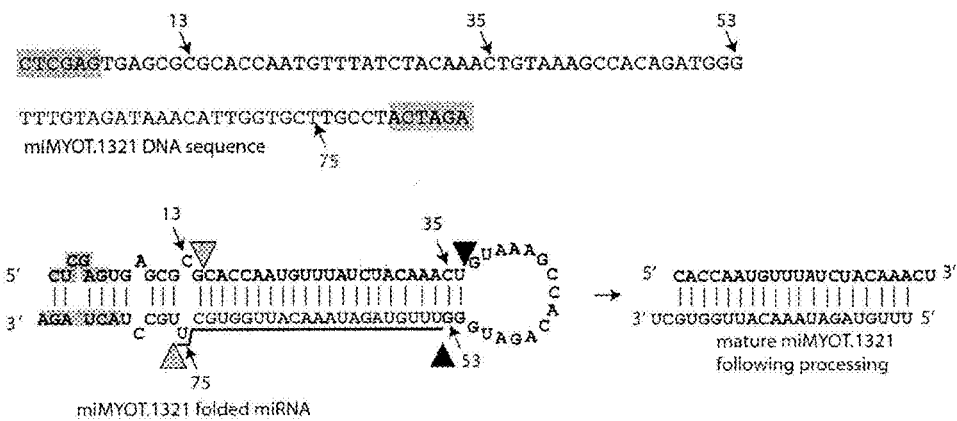
Binds MYOT sequences 1321-1342 from Genbank file: AF144477.1
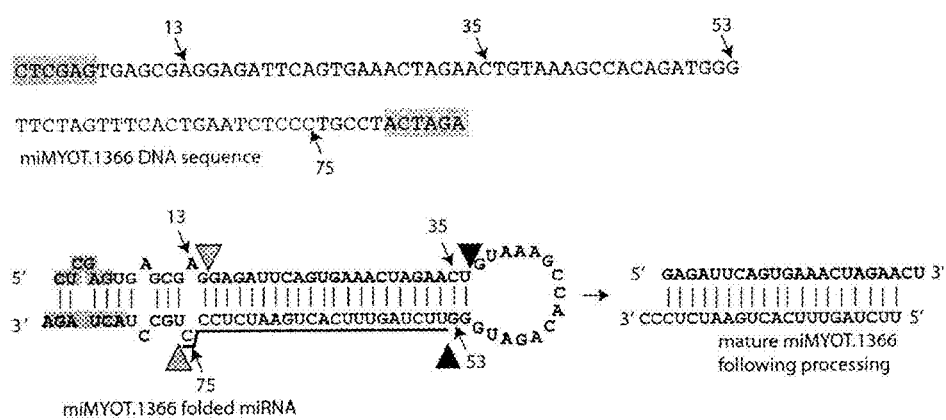
Binds MYOT sequences 1366-1387 from Genbank file: AF144477.1

L = miMYOT injection  R=miGFP injection

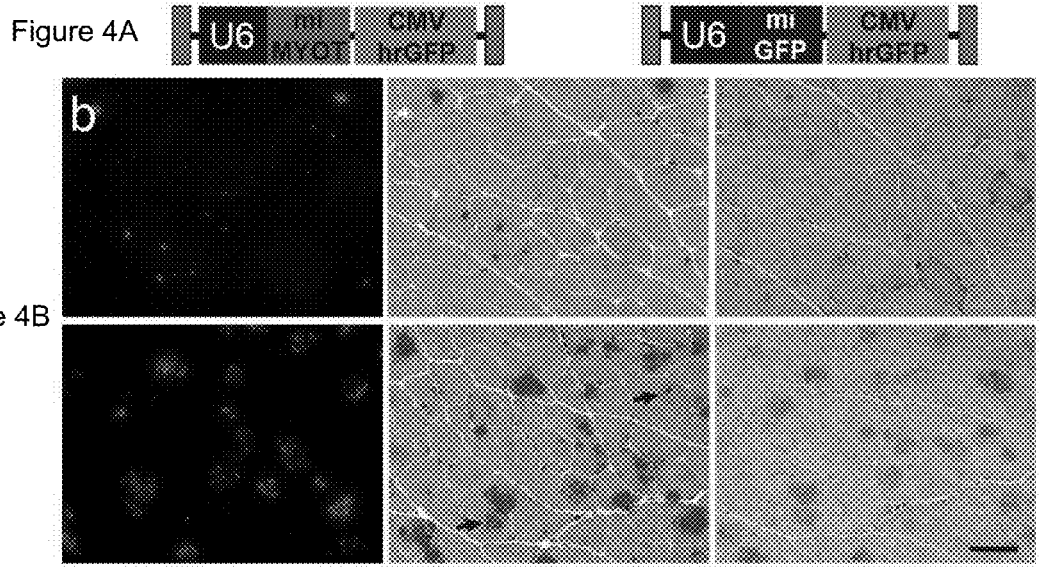
Figure 4A
Figure 4B
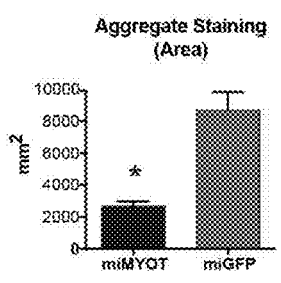
Figure 4C
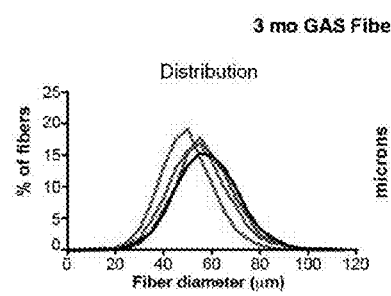
Figure 4D
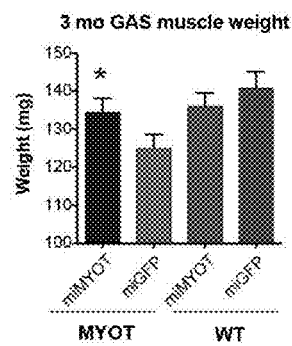
Figure 4E
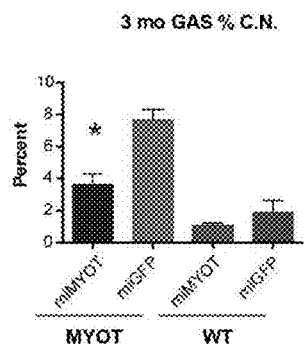
Figure 4F

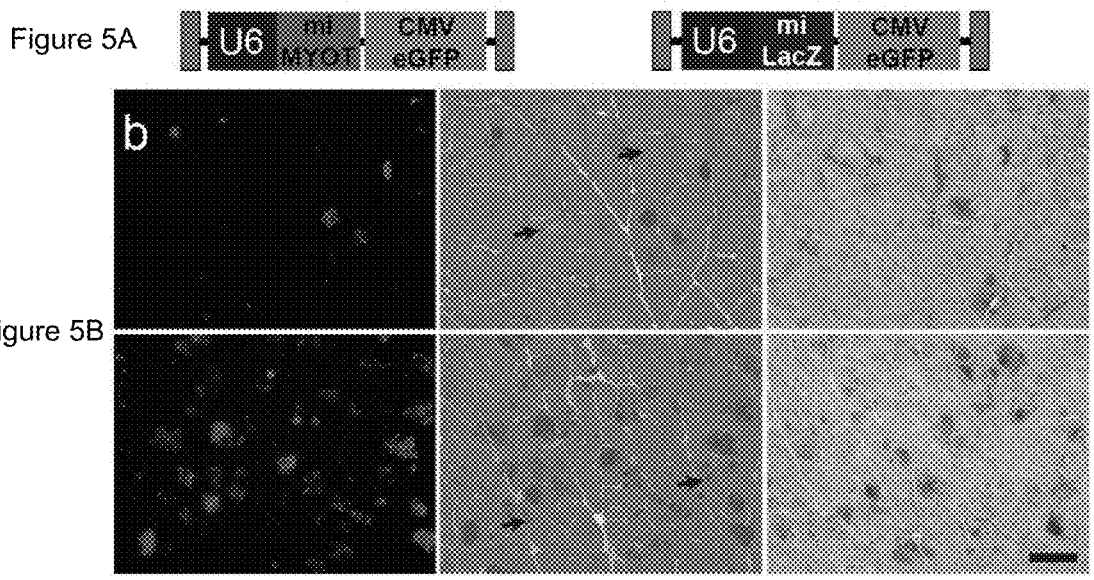
Figure 5A
Figure 5B
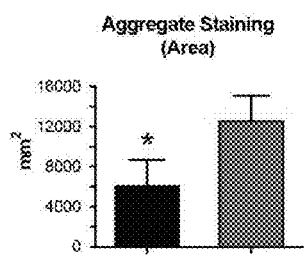
Figure 5C
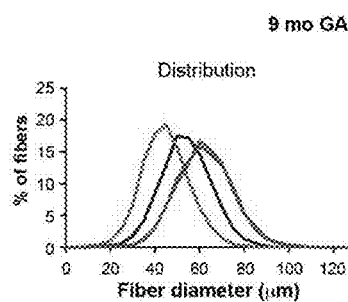
Figure 5D
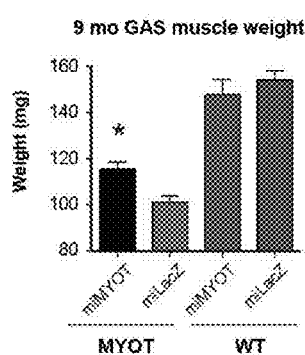
Figure 5E
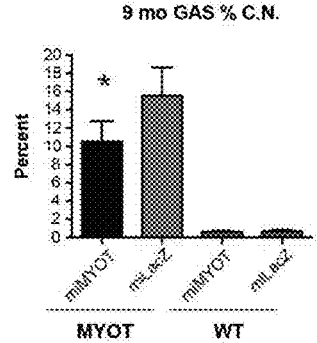
Figure 5F

RECOMBINANT VIRUS PRODUCTS AND METHODS FOR INHIBITION OF EXPRESSION OF MYOTILIN This application is a continuation-in-part of U.S. patent application Ser. No. 14/058,909 filed Jul. 14, 2014, which is in turn a continuation-in-part of International Application No. PCT/US2012/034408 filed Apr. 20, 2012, which claims priority to U.S. Provisional Patent Application No. 61/478,012 filed Apr. 21, 2011, all of which are incorporated by reference herein in their entirety.

FIELD OF THE INVENTION

The present invention relates to RNA interference-based methods for inhibiting the expression of the myotilin gene. Recombinant adeno-associated viruses of the invention deliver DNAs encoding microRNAs that knock down the expression of myotilin. The methods have application in the treatment of muscular dystrophies such as Limb Girdle Muscular Dystrophy Type 1A.

INCORPORATION BY REFERENCE OF THE SEQUENCE LISTING

This application contains, as a separate part of disclosure, a Sequence Listing in computer-readable form (filename: 46208CIP_SeqListing.txt; 1,723,211 bytes—ASCII text file created Sep. 14, 2015) which is incorporated by reference herein in its entirety.

BACKGROUND

Muscular dystrophies (MDs) are a group of genetic diseases. The group is characterized by progressive weakness and degeneration of the skeletal muscles that control movement. Some forms of MD develop in infancy or childhood, while others may not appear until middle age or later. The disorders differ in terms of the distribution and extent of muscle weakness (some forms of MD also affect cardiac muscle), the age of onset, the rate of progression, and the pattern of inheritance.

One group of MDs is the limb girdle group (LGMD) of MDs. LGMDs are rare conditions and they present differently in different people with respect to age of onset, areas of muscle weakness, heart and respiratory involvement, rate of progression and severity. LGMDs can begin in childhood, adolescence, young adulthood or even later. Both genders are affected equally. LGMDs cause weakness in the shoulder and pelvic girdle, with nearby muscles in the upper legs and arms sometimes also weakening with time. Weakness of the legs often appears before that of the arms. Facial muscles are usually unaffected. As the condition progresses, people can have problems with walking and may need to use a wheelchair over time. The involvement of shoulder and arm muscles can lead to difficulty in raising arms over head and in lifting objects. In some types of LGMD, the heart and breathing muscles may be involved.

There are at least nineteen forms of LGMD, and the forms are classified by their associated genetic defects.

| Type | Pattern of Inheritance | Gene or Chromosome |
| --- | --- | --- |
| LGMD1A | Autosomal dominant | Myotilin gene |
| LGMD1B | Autosomal dominant | Lamin A/C gene |
| LGMD1C | Autosomal dominant | Caveolin gene |
| LGMD1D | Autosomal dominant | Chromosome 7 |
| LGMD1E | Autosomal dominant | Desmin gene |
| LGMD1F | Autosomal dominant | Chromosome 7 |
| LGMD1G | Autosomal dominant | Chromosome 4 |
| LGMD2A | Autosomal recessive | Calpain-3 gene |
| LGMD2B | Autosomal recessive | Dysferlin gene |
| LGMD2C | Autosomal recessive | Gamma-sarcoglycan gene |
| LGMD2D | Autosomal recessive | Alpha-sarcoglycan gene |
| LGMD2E | Autosomal recessive | Beta-sarcoglycan gene |
| LGMD2F | Autosomal recessive | Delta-sarcoglycan gene |
| LGMD2G | Autosomal recessive | Telethonin gene |
| LGMD2H | Autosomal recessive | TRIM32 |
| LGMD2I | Autosomal recessive | FKRP gene |
| LGMD2J | Autosomal recessive | Titin gene |
| LGMD2K | Autosomal recessive | POMT1 gene |
| LGMD2L | Autosomal recessive | Fukutin gene |

Specialized tests for LGMD are now available through a national scheme for diagnosis, the National Commissioning Group (NCG).

LGMD1A is caused by gain-of-function missense mutations in the myotilin (MYOT) gene [Hauser et al., Am. J. Hum. Genet, 71: 1428-1432 (2002); Hauser et al., Hum. Mol. Genet., 9: 2141-2147 (2000); Shalaby et al., J. Neuropathol. Exp. Neurol., 68: 701-707 (2009)]. LGMD1A patients develop proximal leg and arm weakness in early adulthood (25 years is mean onset age), which progresses to the distal limb musculature. At the histological level, patients show myofiber degeneration and size variability, fiber splitting, centrally located myonuclei, autophagic vesicles, and replacement of myofibers with fat and fibrotic tissue, which are all common features of muscular dystrophy. Patients with LGMD1A also develop intramuscular myofibrillar protein aggregates, rimmed vacuoles, and severe Z-disc disorganization (called Z-disc streaming), which completely disrupt the sarcomeric structure. A transgenic mouse model, the T57I mouse model, using a mutant human MYOT allele has been developed [Garvey et al., Hum. Mol. Genet. 15: 2348-2362 (2006)]. Importantly, T57I mice recapitulate the progressive histological and functional abnormalities associated with LGMD1A, including reduced muscle size, muscle weakness, intramuscular myofibrillar aggregates, Z-disc streaming, and centrally located myonuclei.

The myotilin gene encodes a 57 kDa protein expressed primarily in skeletal and cardiac muscle. Myotilin appears to function as a structural component of the Z-disc, and may therefore contribute to sarcomere assembly, actin filament stabilization, and force transmission in striated muscle. Nevertheless, myotilin is not required for normal muscle development or function, since myotilin null mice are overtly and histologically normal. Specifically, mouse muscles lacking myotilin are indistinguishable from wild type in muscle mass, myofiber size, contractile strength (specific force), and sarcolemmal integrity. Moreover, MYOT null mice develop normally, live a normal life span, and show no histological evidence of muscular dystrophy or Z-disc malformations. Mouse and human myotilin transcripts are expressed in the same tissues, have the same genomic structures, and protein sequences are highly conserved (90% identity; 94% similarity), which indicates a conserved functional.

RNA interference (RNAi) is a mechanism of gene regulation in eukaryotic cells that has been considered for the treatment of various diseases. RNAi refers to post-transcriptional control of gene expression mediated by microRNAs (miRNAs). The miRNAs are small (21-25 nucleotides), noncoding RNAs that share sequence homology and base-pair with cognate messenger RNAs (mRNAs). The interaction between the miRNAs and mRNAs directs cellular gene silencing machinery to prevent the translation of the mRNAs. The RNAi pathway is summarized in Duan (Ed.), Section 7.3 of Chapter 7 in Muscle Gene Therapy, Springer Science+Business Media, LLC (2010). Section 7.4 mentions MYOT RNAi therapy of LGMD1A in mice to demonstrate proof-of-principle for RNAi therapy of dominant muscle disorders.

As an understanding of natural RNAi pathways has developed, researchers have designed artificial miRNAs for use in regulating expression of target genes for treating disease. As described in Section 7.4 of Duan, supra, artificial miRNAs can be transcribed from DNA expression cassettes. The miRNA sequence specific for a target gene is transcribed along with sequences required to direct processing of the miRNA in a cell. Viral vectors such as adeno-associated virus have been used to deliver miRNAs to muscle [Fechner et al., J. Mol. Med., 86: 987-997 (2008).

Adeno-associated virus (AAV) is a replication-deficient parvovirus, the single-stranded DNA genome of which is about 4.7 kb in length including 145 nucleotide inverted terminal repeat (ITRs). There are multiple serotypes of AAV. The nucleotide sequences of the genomes of the AAV serotypes are known. For example, the complete genome of AAV-1 is provided in GenBank Accession No. NC_002077; the complete genome of AAV-2 is provided in GenBank Accession No. NC_001401 and Srivastava et al., J. Virol., 45: 555-564 {1983); the complete genome of AAV-3 is provided in GenBank Accession No. NC_1829; the complete genome of AAV-4 is provided in GenBank Accession No. NC_001829; the AAV-5 genome is provided in GenBank Accession No. AF085716; the complete genome of AAV-6 is provided in GenBank Accession No. NC_00 1862; at least portions of AAV-7 and AAV-8 genomes are provided in GenBank Accession Nos. AX753246 and AX753249, respectively; the AAV-9 genome is provided in Gao et al., J. Virol., 78: 6381-6388 (2004); the AAV-10 genome is provided in Mol. Ther., 13(1): 67-76 (2006); and the AAV-11 genome is provided in Virology, 330(2): 375-383 (2004). Cis-acting sequences directing viral DNA replication (rep), encapsidation/packaging and host cell chromosome integration are contained within the AAV ITRs. Three AAV promoters (named p5, p19, and p40 for their relative map locations) drive the expression of the two AAV internal open reading frames encoding rep and cap genes. The two rep promoters (p5 and p19), coupled with the differential splicing of the single AAV intron (at nucleotides 2107 and 2227), result in the production of four rep proteins (rep 78, rep 68, rep 52, and rep 40) from the rep gene. Rep proteins possess multiple enzymatic properties that are ultimately responsible for replicating the viral genome. The cap gene is expressed from the p40 promoter and it encodes the three capsid proteins VP1, VP2, and VP3. Alternative splicing and non-consensus translational start sites are responsible for the production of the three related capsid proteins. A single consensus polyadenylation site is located at map position 95 of the AAV genome. The life cycle and genetics of AAV are reviewed in Muzyczka, Current Topics in Microbiology and Immunology, 158: 97-129 (1992).

AAV possesses unique features that make it attractive as a vector for delivering foreign DNA to cells, for example, in gene therapy. AAV infection of cells in culture is noncytopathic, and natural infection of humans and other animals is silent and asymptomatic. Moreover, AAV infects many mammalian cells allowing the possibility of targeting many different tissues in vivo. Moreover, AAV transduces slowly dividing and non-dividing cells, and can persist essentially for the lifetime of those cells as a transcriptionally active nuclear episome (extrachromosomal element). The AAV proviral genome is infectious as cloned DNA in plasmids which makes construction of recombinant genomes feasible. Furthermore, because the signals directing AAV replication, genome encapsidation and integration are contained within the ITRs of the AAV genome, some or all of the internal approximately 4.3 kb of the genome (encoding replication and structural capsid proteins, rep-cap) may be replaced with foreign DNA. The rep and cap proteins may be provided in trans. Another significant feature of AAV is that it is an extremely stable and hearty virus. It easily withstands the conditions used to inactivate adenovirus (56° to 65° C. for several hours), making cold preservation of AAV less critical. AAV may even be lyophilized. Finally, AAV-infected cells are not resistant to superinfection.

There remains a need in the art for a treatment for LGMD1A.

SUMMARY

The present invention provides methods and products for preventing or inhibiting the expression of the MYOT gene. The methods of the invention utilize RNAi to prevent or inhibit the expression of the MYOT gene. The methods involve delivering inhibitory RNAs specific for the MYOT gene to muscle cells. The MYOT inhibitory RNAs contemplated include, but are not limited to, antisense RNAs, small inhibitory RNAs (siRNAs), short hairpin RNAs (shRNAs) or artificial microRNAs (MYOT miRNAs) that inhibit expression of MYOT. Use of the methods and products is indicated, for example, in preventing or treating LGMD1A. Some embodiments of the invention exploit the unique properties of AAV to deliver DNA encoding MYOT inhibitory RNAs to muscle cells. Other embodiments of the invention utilize other vectors (for example, other viral vectors such as adenovirus, retrovirus, lentivirus, equine-associated virus, alphavirus, pox viruses, herpes virus, polio virus, sindbis virus and vaccinia viruses) to deliver polynucleotides encoding MYOT inhibitory RNAs.

In one aspect, the invention provides MYOT miRNAs. In another aspect, the invention provides rAAV encoding the MYOT miRNAs wherein the rAAV lack rep and cap genes. In some embodiments, the MYOT miRNA comprises an miRNA antisense guide strand selected from those set out in SEQ ID NO: 7 through SEQ ID NO: 11266. These sequences comprise antisense "guide" strand sequences of the invention of varying sizes. The antisense guide strand is the strand of the mature miRNA duplex that becomes the RNA component of the RNA induced silencing complex ultimately responsible for sequence-specific gene silencing. See Section 7.3 of Duan, supra. For example, the first antisense guide strand in SEQ ID NO: 7 corresponds to (is the reverse complement of) the 3' end of the myotilin sequence set out in FIG. 1. The second antisense guide strand (SEQ ID NO: 8) is offset one nucleotide from the first and so on. In some embodiments, the GC content of the antisense guide strand is 60% or less, and/or the 5' end of the antisense guide strand is more AU rich while the 3' end is more GC rich. Exemplified MYOT miRNA are encoded by the DNAs set out in SEQ ID NOs: 1, 2, 3, 4, 11286, 11287 and 11288. In some embodiments, rAAV are self-complementary (sc) AAV. In some embodiments, the MYOT miRNA encoding sequences are under the control of a muscle-specific tMCK or CK6 promoter.

In another aspect, the invention provides a composition comprising the rAAV encoding the MYOT miRNA.

In yet another aspect, the invention provides a method of preventing or inhibiting expression of the MYOT gene in a cell comprising contacting the cell with a rAAV encoding an MYOT miRNA, wherein the miRNA is encoded by the DNA set out in SEQ ID NO: 11286, 11287 or 11288, and wherein the rAAV lacks rep and cap genes. Expression of MYOT is inhibited by at least 10, 20, 30, 40, 50, 60, 70, 80, 90, 95 or 99 percent.

In still another aspect, the invention provides a method of delivering DNA encoding the MYOT miRNA set out in SEQ ID NO: 11286, 11287 or 11288 to an animal in need thereof, comprising respectively administering to the animal a rAAV encoding the MYOTmi RNA, wherein the rAAV lacks rep and cap genes.

In yet another aspect, the invention provides a method of preventing or treating a musclular dystrophy (including, but not limited to, LGMD1A) comprising administering a rAAV encoding an MYOT miRNA, wherein the miRNA is encoded by the DNA set out in SEQ ID NO: 11286, 11287 or 11288 and wherein the rAAV lacks rep and cap genes. "Treating" may include ameliorating one or more symptoms of the muscular dystrophy (such as LGMD1A). Molecular, biochemical, histological, and functional endpoints demonstrate the therapeutic efficacy of MYOT miRNAs. Endpoints contemplated by the invention include one or more of: the reduction or elimination of mutant MYOT protein in affected muscles, MYOT gene knockdown, reduction or elimination of (for example, LGMD1A-associated) pathogenic protein aggregates in muscle, increase in myofiber diameters, and improvement in muscle strength.

DETAILED DESCRIPTION

Recombinant AAV genomes of the invention comprise one or more AAV ITRs flanking a polynucleotide encoding, for example, one or more MYOT miRNAs. The polynucleotide is operatively linked to transcriptional control DNA, specifically promoter DNA that is functional in target. Commercial providers such as Ambion Inc. (Austin, Tex.), Darmacon Inc. (Lafayette, Colo.), InvivoGen (San Diego, Calif.), and Molecular Research Laboratories, LLC (Herndon, Va.) generate custom inhibitory RNA molecules. In addition, commercial kits are available to produce custom siRNA molecules, such as SILENCER™ siRNA Construction Kit (Ambion Inc., Austin, Tex.) or psiRNA System (InvivoGen, San Diego, Calif.). Embodiments include a rAAV genome comprising: the DNA set out in SEQ ID NO: 1 encoding the MYOT miRNA named "miMyoT-1291," the DNA set out in SEQ ID NO: 2 encoding the MYOT miRNA named "miMyoT-1321," the DNA set out in SEQ ID NO: 3 encoding the MYOT miRNA named "miMyoT-1366" or the DNA set out in SEQ ID NO: 4 encoding the MYOT miRNA named "miMyoT-1490." Additional embodiments include, but are not limited to, a rAAV genome comprising: the DNA set out in SEQ ID NO: 11286 encoding the MYOT miRNA named "miMyoT-1043," the DNA set out in SEQ ID NO: 11287 encoding the MYOT miRNA named "miMyoT-1044," and the DNA set out in SEQ ID NO: 11288 encoding the MYOT miRNA named "miMyoT-1634."

The rAAV genomes of the invention lack AAV rep and cap DNA. AAV DNA in the rAAV genomes may be from any AAV serotype for which a recombinant virus can be derived including, but not limited to, AAV serotypes AAV-1, AAV-2, AAV-3, AAV-4, AAV-5, AAV-6, AAV-7, AAV-8, AAV-9, AAV-10 and AAV-11. As noted in the Background section above, the nucleotide sequences of the genomes of various AAV serotypes are known in the art.

DNA plasmids of the invention comprise rAAV genomes of the invention. The DNA plasmids are transferred to cells permissible for infection with a helper virus of AAV (e.g., adenovirus, E1-deleted adenovirus or herpesvirus) for assembly of the rAAV genome into infectious viral particles. Techniques to produce rAAV particles, in which an AAV genome to be packaged, rep and cap genes, and helper virus functions are provided to a cell are standard in the art. Production of rAAV requires that the following components are present within a single cell (denoted herein as a packaging cell): a rAAV genome, AAV rep and cap genes separate from (i.e., not in) the rAAV genome, and helper virus functions. The AAV rep and cap genes may be from any AAV serotype for which recombinant virus can be derived and may be from a different AAV serotype than the rAAV genome ITRs, including, but not limited to, AAV serotypes AAV-1, AAV-2, AAV-3, AAV-4, AAV-5, AAV-6, AAV-7, AAV-8, AAV-9, AAV-10 and AAV-11. Production of pseudotyped rAAV is disclosed in, for example, WO 01/83692 which is incorporated by reference herein in its entirety.

A method of generating a packaging cell is to create a cell line that stably expresses all the necessary components for AAV particle production. For example, a plasmid (or multiple plasmids) comprising a rAAV genome lacking AAV rep and cap genes, AAV rep and cap genes separate from the rAAV genome, and a selectable marker, such as a neomycin resistance gene, are integrated into the genome of a cell. AAV genomes have been introduced into bacterial plasmids by procedures such as GC tailing (Samulski et al., 1982, Proc. Natl. Acad. S6. USA, 79:2077-2081), addition of synthetic linkers containing restriction endonuclease cleavage sites (Laughlin et al., 1983, Gene, 23:65-73) or by direct, blunt-end ligation (Senapathy & Carter, 1984, J. Biol. Chem., 259:4661-4666). The packaging cell line is then infected with a helper virus such as adenovirus. The advantages of this method are that the cells are selectable and are suitable for large-scale production of rAAV. Other examples of suitable methods employ adenovirus or baculovirus rather than plasmids to introduce rAAV genomes and/or rep and cap genes into packaging cells.

General principles of rAAV production are reviewed in, for example, Carter, 1992, Current Opinions in Biotechnology, 1533-539; and Muzyczka, 1992, Curr. Topics in Microbial. and Immunol., 158:97-129). Various approaches are described in Ratschin et al., Mol. Cell. Biol. 4:2072 (1984); Hermonat et al., Proc. Natl. Acad. Sci. USA, 81:6466 (1984); Tratschin et al., Mol. Cell. Biol. 5:3251 (1985); McLaughlin et al., J. Virol., 62:1963 (1988); and Lebkowski et al., 1988 Mol. Cell. Biol., 7:349 (1988). Samulski et al. (1989, J. Virol., 63:3822-3828); U.S. Pat. No. 5,173,414; WO 95/13365 and corresponding U.S. Pat. No. 5,658,776; WO 95/13392; WO 96/17947; PCT/US98/18600; WO 97/09441 (PCT/US96/14423); WO 97/08298 (PCT/US96/13872); WO 97/21825 (PCT/US96/20777); WO 97/06243 (PCT/FR96/01064); WO 99/11764; Perrin et al. (1995) Vaccine 13:1244-1250; Paul et al. (1993) Human Gene Therapy 4:609-615; Clark et al. (1996) Gene Therapy 3:1124-1132; U.S. Pat. No. 5,786,211; U.S. Pat. No. 5,871,982; U.S. Pat. No. 6,258,595; and McCarty, Mol. Ther., 16(10): 1648-1656 (2008). The foregoing documents are hereby incorporated by reference in their entirety herein, with particular emphasis on those sections of the documents relating to rAAV production. The production and use of sc rAAV are specifically contemplated.

The invention thus provides packaging cells that produce infectious rAAV. In one embodiment packaging cells may be stably transformed cancer cells such as HeLa cells, 293 cells and PerC.6 cells (a cognate 293 line). In another embodiment, packaging cells are cells that are not transformed cancer cells, such as low passage 293 cells (human fetal kidney cells transformed with E1 of adenovirus), MRC-5 cells (human fetal fibroblasts), WI-38 cells (human fetal fibroblasts), Vero cells (monkey kidney cells) and FRhL-2 cells (rhesus fetal lung cells).

Recombinant AAV (i.e., infectious encapsidated rAAV particles) of the invention comprise a rAAV genome. Embodiments include, but are not limited to, the rAAV including a genome encoding the MYOT miRNA set out in SEQ ID NO: 1 (named "AAV-U6-miMyoT-1291"), the rAAV including a genome encoding the MYOT miRNA set out in SEQ ID NO: 2 (named "AAV-U6-miMyoT-1321"), the rAAV including a genome encoding the MYOT miRNA set out in SEQ ID NO: 3 (named "AAV-U6-miMyoT-1366") and the rAAV including a genome encoding the MYOT miRNA set out in SEQ ID NO: 4 (named "AAV-U6-miMyoT-1490"). Additional embodiments include, but are not limited to, the rAAV including a genome encoding the MYOT miRNA set out in SEQ ID NO: 11286 (named "scAAV-tMCK-miMyoT-1043"), the rAAV including a genome encoding the MYOT miRNA set out in SEQ ID NO: 11287 (named "AAV-tMCK-iMyoT-1044") and the rAAV including a genome encoding the MYOT miRNA set out in SEQ ID NO: 11288 (named "AAV-tMCK-miMyoT-1634"). The genomes of the rAAV lack AAV rep and cap DNA, that is, there is no AAV rep or cap DNA between the ITRs of the genomes.

The rAAV may be purified by methods standard in the art such as by column chromatography or cesium chloride gradients. Methods for purifying rAAV vectors from helper virus are known in the art and include methods disclosed in, for example, Clark et al., Hum. Gene Ther., 10(6): 1031-1039 (1999); Schenpp and Clark, Methods Mol. Med., 69 427-443 (2002); U.S. Pat. No. 6,566,118 and WO 98/09657.

In another embodiment, the invention contemplates compositions comprising rAAV of the present invention. Compositions of the invention comprise rAAV in a pharmaceutically acceptable carrier. The compositions may also comprise other ingredients such as diluents and adjuvants. Acceptable carriers, diluents and adjuvants are nontoxic to recipients and are preferably inert at the dosages and concentrations employed, and include buffers such as phosphate, citrate, or other organic acids; antioxidants such as ascorbic acid; low molecular weight polypeptides; proteins, such as serum albumin, gelatin, or immunoglobulins; hydrophilic polymers such as polyvinylpyrrolidone; amino acids such as glycine, glutamine, asparagine, arginine or lysine; monosaccharides, disaccharides, and other carbohydrates including glucose, mannose, or dextrins; chelating agents such as EDTA; sugar alcohols such as mannitol or sorbitol; salt-formig counterions such as sodium; and/or nonionic surfactants such as Tween, pluronics or polyethylene glycol (PEG).

Titers of rAAV to be administered in methods of the invention will vary depending, for example, on the particular rAAV, the mode of administration, the treatment goal, the individual, and the cell type(s) being targeted, and may be determined by methods standard in the art. Titers of rAAV may range from about $1 \times 10^6$, about $1 \times 10^7$, about $1 \times 10^8$, about $1 \times 10^9$, about $1 \times 10^{10}$, about $1 \times 10^{11}$, about $1 \times 10^{12}$, about $1 \times 10^{13}$ to about $1 \times 10^{14}$ or more DNase resistant particles (DRP) per ml. Dosages may also be expressed in units of viral genomes (vg).

Methods of transducing a target cell with rAAV, in vivo or in vitro, are contemplated by the invention. The in vivo methods comprise the step of administering an effective dose, or effective multiple doses, of a composition comprising a rAAV of the invention to an animal (including a human being) in need thereof. If the dose is administered prior to development of a disorder/disease, the administration is prophylactic. If the dose is administered after the development of a disorder/disease, the administration is therapeutic. In embodiments of the invention, an effective dose is a dose that alleviates (eliminates or reduces) at least one symptom associated with the disorder/disease state being treated, that slows or prevents progression to a disorder/disease state, that slows or prevents progression of a disorder/disease state, that diminishes the extent of disease, that results in remission (partial or total) of disease, and/or that prolongs survival. An example of a disease contemplated for prevention or treatment with methods of the invention is LGMD1A.

Combination therapies are also contemplated by the invention. Combination as used herein includes both simultaneous treatment or sequential treatments. Combinations of methods of the invention with standard medical treatments (e.g., corticosteroids) are specifically contemplated, as are combinations with novel therapies.

Administration of an effective dose of the compositions may be by routes standard in the art including, but not limited to, intramuscular, parenteral, intravenous, oral, buccal, nasal, pulmonary, intracranial, intraosseous, intraocular, rectal, or vaginal. Route(s) of administration and serotype(s) of AAV components of the rAAV (in particular, the AAV ITRs and capsid protein) of the invention may be chosen and/or matched by those skilled in the art taking into account the infection and/or disease state being treated and the target cells/tissue(s) that are to express the MYOT miRNAs.

In particular, actual administration of rAAV of the present invention may be accomplished by using any physical method that will transport the rAAV recombinant vector into the target tissue of an animal. Administration according to the invention includes, but is not limited to, injection into muscle, the bloodstream and/or directly into the liver. Simply resuspending a rAAV in phosphate buffered saline has been demonstrated to be sufficient to provide a vehicle useful for muscle tissue expression, and there are no known restrictions on the carriers or other components that can be co-administered with the rAAV (although compositions that degrade DNA should be avoided in the normal manner with rAAV). Capsid proteins of a rAAV may be modified so that the rAAV is targeted to a particular target tissue of interest such as muscle. See, for example, WO 02/053703, the disclosure of which is incorporated by reference herein. Pharmaceutical compositions can be prepared as injectable formulations or as topical formulations to be delivered to the muscles by transdermal transport. Numerous formulations for both intramuscular injection and transdermal transport have been previously developed and can be used in the practice of the invention. The rAAV can be used with any pharmaceutically acceptable carrier for ease of administration and handling.

For purposes of intramuscular injection, solutions in an adjuvant such as sesame or peanut oil or in aqueous propylene glycol can be employed, as well as sterile aqueous solutions. Such aqueous solutions can be buffered, if desired, and the liquid diluent first rendered isotonic with saline or glucose. Solutions of rAAV as a free acid (DNA contains acidic phosphate groups) or a pharmacologically acceptable salt can be prepared in water suitably mixed with a surfactant such as hydroxpropylcellulose. A dispersion of rAAV can also be prepared in glycerol, liquid polyethylene glycols and mixtures thereof and in oils. Under ordinary conditions of storage and use, these preparations contain a preservative to prevent the growth of microorganisms. In this connection, the sterile aqueous media employed are all readily obtainable by standard techniques well-known to those skilled in the art.

The pharmaceutical forms suitable for injectable use include sterile aqueous solutions or dispersions and sterile powders for the extemporaneous preparation of sterile injectable solutions or dispersions. In all cases the form must be sterile and must be fluid to the extent that easy syringability exists. It must be stable under the conditions of manufacture and storage and must be preserved against the contaminating actions of microorganisms such as bacteria and fungi. The carrier can be a solvent or dispersion medium containing, for example, water, ethanol, polyol (for example, glycerol, propylene glycol, liquid polyethylene glycol and the like), suitable mixtures thereof, and vegetable oils. The proper fluidity can be maintained, for example, by the use of a coating such as lecithin, by the maintenance of the required particle size in the case of a dispersion and by the use of surfactants. The prevention of the action of microorganisms can be brought about by various antibacterial and antifungal agents, for example, parabens, chlorobutanol, phenol, sorbic acid, thimerosal and the like. In many cases it will be preferable to include isotonic agents, for example, sugars or sodium chloride. Prolonged absorption of the injectable compositions can be brought about by use of agents delaying absorption, for example, aluminum monostearate and gelatin.

Sterile injectable solutions are prepared by incorporating rAAV in the required amount in the appropriate solvent with various other ingredients enumerated above, as required, followed by filter sterilization. Generally, dispersions are prepared by incorporating the sterilized active ingredient into a sterile vehicle which contains the basic dispersion medium and the required other ingredients from those enumerated above. In the case of sterile powders for the preparation of sterile injectable solutions, the preferred methods of preparation are vacuum drying and the freeze drying technique that yield a powder of the active ingredient plus any additional desired ingredient from the previously sterile-filtered solution thereof.

Transduction with rAAV may also be carried out in vitro. In one embodiment, desired target muscle cells are removed from the subject, transduced with rAAV and reintroduced into the subject. Alternatively, syngeneic or xenogeneic muscle cells can be used where those cells will not generate an inappropriate immune response in the subject.

Suitable methods for the transduction and reintroduction of transduced cells into a subject are known in the art. In one embodiment, cells can be transduced in vitro by combining rAAV with muscle cells, e.g., in appropriate media, and screening for those cells harboring the DNA of interest using conventional techniques such as Southern blots and/or PCR, or by using selectable markers. Transduced cells can then be formulated into pharmaceutical compositions, and the composition introduced into the subject by various techniques, such as by intramuscular, intravenous, subcutaneous and intraperitoneal injection, or by injection into smooth and cardiac muscle, using e.g., a catheter.

Transduction of cells with rAAV of the invention results in sustained expression of MYOT miRNAs. The present invention thus provides methods of administering/delivering rAAV which express MYOT miRNAs to an animal, preferably a human being. These methods include transducing tissues (including, but not limited to, tissues such as muscle, organs such as liver and brain, and glands such as salivary glands) with one or more rAAV of the present invention. Transduction may be carried out with gene cassettes comprising tissue specific control elements. For example, one embodiment of the invention provides methods of transducing muscle cells and muscle tissues directed by muscle specific control elements, including, but not limited to, those derived from the actin and myosin gene families, such as from the myoD gene family [See Weintraub et al., Science, 251: 761-766 (1990], the myocyte-specific enhancer binding factor MEF-2 [Cserjesi and Olson, Mol Cell Biol 11: 4854-4862 (1990], control elements derived from the human skeletal actin gene [Muscat et al., Mol Cell Biol, 7: 4089-4099 (1987)], the cardiac actin gene, muscle creatine kinase sequence elements [See Johnson et al., Mol Cell Biol, 9:3393-3399 (1989)] and the murine creatine kinase enhancer (mCK) element, control elements derived from the skeletal fast-twitch troponin C gene, the slow-twitch cardiac troponin C gene and the slow-twitch troponin I gene: hypozia-inducible nuclear factors [Semenza et al., Proc Natl Acad Sci USA, 88: 5680-5684 (1990), steroid-inducible elements and promoters including the glucocorticoid response element (GRE) [See Mader and White, Proc. Natl. Acad. Sci. USA, 90: 5603-5607 (1993)], the tMCK promoter [see Wang et al., Gene Therapy, 15: 1489-1499 (2008)], the CK6 promoter [see Wang et al., supra] and other control elements.

Muscle tissue is an attractive target for in vivo DNA delivery, because it is not a vital organ and is easy to access. The invention contemplates sustained expression of miRNAs from transduced myofibers.

By "muscle cell" or "muscle tissue" is meant a cell or group of cells derived from muscle of any kind (for example, skeletal muscle and smooth muscle, e.g. from the digestive tract, urinary bladder, blood vessels or cardiac tissue). Such muscle cells may be differentiated or undifferentiated, such as myoblasts, myocytes, myotubes, cardiomyocytes and cardiomyoblasts.

The term "transduction" is used to refer to the administration/delivery of MYOT miRNAs to a recipient cell either in vivo or in vitro, via a replication-deficient rAAV of the invention resulting in expression of a MYOT miRNA by the recipient cell.

Thus, the invention provides methods of administering an effective dose (or doses, administered essentially simultaneously or doses given at intervals) of rAAV that encode MYOT miRNAs to a patient in need thereof.

BRIEF DESCRIPTION OF THE DRAWINGS

This patent or application file contains at least one drawing executed in color. Copies of this patent or patent application publication with color drawing(s) will be provided by the Office upon request and payment of the necessary fee.

FIG. 1 shows target sites in the myotilin sequence (SEQ ID NO: 11266) for exemplified miRNAs.

FIG. 2 sets out sequences of two MYOT-targeted miRNAs. In each panel, the top sequences indicate the DNA templates from which each respective miRNA is transcribed. In the top panel, the DNA template miMYOT.1321 is SEQ ID NO: 2. In the bottom panel, the DNA template miMYOT.1366 is SEQ ID NO: 3. The folded miRNA transcripts are shown as hairpin structures. The miMYOT.1321 folded miRNA is SEQ ID NO: 11268. The miMYOT.1366 folded miRNA is SEQ ID NO: 11271. The mature miMYO.1321 (SEQ ID NO: 11270 which pairs with SEQ ID NO: 11269 in the figure) and miDUX4.1366 (SEQ ID NO: 11273 which pairs with SEQ ID NO: 11272 in the figure) sequences arise following processing in target cells by host miRNA processing machinery (including Drosha, DGCR8, Dicer, and Exportin-5). Sequences shaded in gray indicate sites used for cloning each miRNA into the U6T6 vector. The nucleotides corresponding to the mature miRNA antisense guide strand that ultimately helps catalyze cleavage of the MYOT target mRNA are underlined in the miRNA hairpin portions of this diagram. The gray and black arrowheads indicate Drosha- and Dicer-catalyzed cleavage sites, respectively. The numbers 13, 35, 53, and 75 are provided for orientation. The sequences between (and including) positions 35-53 are derived from the natural human mir-30a sequence, except the A at position 39, which is a G is the normal mir-30a sequence. This was changed to an A to facilitate folding of the miRNA loop, based on in silico RNA folding models. The base of the stem (5' of position 13 and 3' of position 75) is also derived from mir-30a structure and sequence with some modifications depending on the primary sequence of the guide strand. Specifically, the nucleotide at position 13 can vary to help facilitate a required mismatched between the position 13 and 75 nucleotides. This bulged structure is hypothesized to facilitate proper Drosha cleavage.

FIG. 3A is a Western blot showing knockdown of mutant mytotilin expression is muscle extracts from three-month old LGMD1A mice, where Left (L)=miMYOT treatment side and Right (R)=miGFP control treated side. FIG. 3B shows real-time PCR results confirming the Western data.

FIGS. 4A, 4B, 4C, 4D, 4E and 4F show AAV.miMYO.1321 (labeled miMYOT in the figure) improves histopathology and muscle weight in 3-mo old TgT57I mice. FIG. 4A. AAV vectors used in 3-mo studies. The miMYOT and control miGFP RNAs are expressed from the mouse U6 promoter. Both vectors contain a CMV.hrGFP reporter gene cassette. Red rectangles indicated AAV inverted terminal repeats (ITRs). FIG. 4B. Representative serial sections from T57I mice injected with AAV.miMYOT (top panels) or AAV.miGFP (bottom panels) controls show reductions in MYOT-seeded protein aggregates. Red spots are protein aggregates stained by immunofluorescence with MYOT antibodies. Middle panels show overlay with H&E-stained serial sections. Arrows indicate fibers containing centrally-located myonuclei. Right panels, aggregates are visible as dark blue spots within the myofiber in serial sections stained with Gomori's Trichrome, while nuclei are purple. Scale bar, 50 μm. Images shown are representative of 8 independently injected animals per virus. FIG. 4C. Quantification of aggregate staining 3 months after injecting TgT57I GAS muscles with AAV.miMYOT or AAV.miGFP. MYOT knockdown significantly reduced the average area of MYOT-positive aggregates by 69% (N=5 muscles per group; 5 randomly sampled fields per muscle; paired t-test, p=0.0069; errors bars represent s.e.m.) FIG. 4D. Graphs show the distribution and average size of TgT57I and wild-type (WT) muscles treated with AAV.miMYOT or AAV.miGFP controls, 3 months post-injection. MYOT knockdown in TgT57I muscles significantly improved myofiber diameter by 4.9 microns (54.8 μm versus 49.9 μm in control-treated TgT57I mice; t-test, p=0.047). WT fiber diameters were 57 and 57.7 microns, in miMYOT- and miGFP-treated animals, respectively. N=5 muscles per group; 5 randomly selected fields per muscle; an average of 1,205 fibers counted per wild-type animals and 1,433 fibers per TgT57I animal). (e) AAV.miMYOT significantly improved GAS muscle weight by 9.5 mg in 3-mo old TgT57I mice (t-test, p<0.001; N=12 muscles per group). AAV.miMYOT treated muscles averaged 134.4 mg in weight versus 124.9 mg in AAV.miGFP-treated animals; WT controls: miMYOT, 136.0 mg; miGFP, 140.8 mg). (f) The mild degeneration-regeneration effects in TgT57I muscles, as indicated by the presence of myofibers with centrally-located nuclei, were significantly improved 2.1-fold with AAV.miMYOT treatment compared to controls (t-test, p=0.0004). Both group of TgT57I mice were still significantly different from respective WT controls (t-test, p<0.006). *, indicates significant difference between miMYOT- and miGFP-treated TgT57I animals. Wild-type animals were not significantly different from one another by all measures, regardless of treatment.

FIGS. 5A, 5B, 5C, 5D, 5E and 5F show AAV.miMYO.1321 (labeled miMYOT in the figure) improves histopathology and muscle weight in 9-mo old TgT57I mice. FIG. 5A. AAV vectors used in 9-mo studies. The miMYOT and control miLacZ RNAs are expressed from the mouse U6 promoter. Both vectors contain a CMV.eGFP reporter gene cassette. Red rectangles indicated AAV inverted terminal repeats (ITRs). FIG. 5B. Representative serial sections from T57I mice injected with AAV.miMYOT (top panels) or AAV.miLacZ (bottom panels) controls show reductions in MYOT-seeded protein aggregates. Red spots are protein aggregates stained by immunofluorescence with MYOT antibodies. Middle panels show overlay with H&E-stained serial sections. Arrows indicate fibers containing centrally-located myonuclei. Right panels, aggregates are visible as dark blue spots within the myofiber in serial sections stained with Gomori's Trichrome, while nuclei are purple. Scale bar, 50 μm. Images shown are representative of 8 independently injected animals per virus. FIG. 5C. Quantification of aggregate staining 9 months after injecting TgT57I GAS muscles with AAV.miMYOT or AAV.miLacZ. MYOT knockdown significantly reduced the average area of MYOT-positive aggregates by 52% (N=5 muscles per group; 5 randomly sampled fields per muscle; paired t-test, p=0.0085; errors bars represent s.e.m.) FIG. 5D. Graphs show the distribution and average size of TgT57I and wild-type (WT) muscles treated with AAV.miMYOT or AAV.miLacZ controls, 9 months post-injection. MYOT knockdown in TgT57I muscles significantly improved myofiber diameter by 9.1 microns (54 μm versus 44.9 μm in control-treated TgT57I mice; t-test, p=0.0006). WT fiber diameters were 62.5 and 62.2 microns, in miMYOT- and miLacZ-treated animals, respectively. These values were significantly larger than either TgT57I group (p<0.001, t-test). N=5 muscles per group; 5 randomly selected fields per muscle; an average of 993 fibers counted per wild-type animals and 1,554 fibers per TgT57I animal). (e) AAV.miMYOT significantly improved GAS muscle weight by 15 mg in 9-mo old TgT57I mice (t-test, p=0.002; N=8 muscles per group). AAV.miMYOT treated muscles averaged 116 mg in weight versus 101 mg in AAV.miLacZ-treated animals; WT controls: miMYOT, 148 mg; miGFP, 154 mg). (f) The mild degeneration-regeneration effects in TgT57I muscles, as indicated by the presence of myofibers with centrally-located nuclei, were significantly improved 2.1-fold with AAV.miMYOT treatment compared to controls (t-test, p=0.0004). Both group of TgT57I mice were still significantly different from respective WT controls (t-test, p<0.0001). *, indicates significant difference between miMYOT- and miLacZ-treated TgT57I animals. Wild-type animals were not significantly different from one another by all measures, regardless of treatment.

EXAMPLES

Figure 3A:
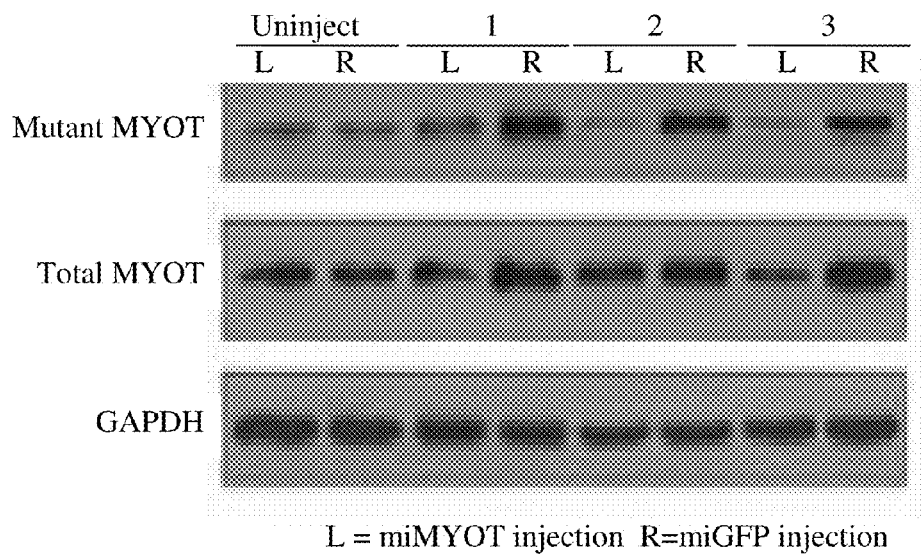
FIGS. 3A and 3B show the effect of MYOT-targeted miRNAs in LGMD1A mice expressing mutant myotilin (MYOT).

Aspects and embodiments of the invention are illustrated by the following examples. Example 1 describes miRNAs specific for the MYOT gene. Example 2 describes the effect of the miRNAs on the expression of MYOT as measured by real-time PCR. Example 3 describes rAAV encoding the miRNAs. Example 4 describes the effect of the U6T6 expressing the miRNAs on the expression of MYOT as measured by Western blot. Example 5 describes delivery of MYOT miRNA to newborn mice. Example 6 describes delivery of MYOT miRNA to adult mice. Example 7 describes dose escalation and self-complementary AAV (scAAV) vectors. Example 8 describes miRNAs with base pair mismatches.

Example 1

MicroRNAs Specific for the MYOT Gene

Six DNAs encoding miRNAs specific for the MYOT gene were generated by PCR. The PCR primers used had the following sequences.

```
Primer 775 (miMyoT-592-Forward)
(SEQ ID NO: 11274):
AAAACTCGAGTGAGCGACCTGATTACAATAGC

AGTAAACTGTAAAGCCACAGATGGG

Primer 776 (miMyoT-592-Reverse)
(SEQ ID NO: 11275):
TTTTACTAGTAGGCAGCCTGATTACAATAGCA

GTAAACCCATCTGTGGCTTTACAG

Primer 777 (miMyoT-1291-Forward)
(SEQ ID NO: 11276):
AAAACTCGAGTGAGCGACTGGATGTCCTTGCA

AAAGAACTGTAAAGCCACAGATGGG

Primer 778 (miMyoT-1291-Reverse)
(SEQ ID NO: 11277):
TTTTACTAGTAGGCAGCTGGATGTCCTTGCAA

AAGAACCCATCTGTGGCTTTACAG

Primer 779 (miMyoT-1321-Forward)
(SEQ ID NO: 11278):
AAAACTCGAGTGAGCGCGCACCAATGTTTATC

TACAAACTGTAAAGCCACAGATGGG

Primer 780 (miMyoT-1321-Reverse)
(SEQ ID NO: 11279):
TTTTACTAGTAGGCAAGCACCAATGTTTATCT

ACAAACCCATCTGTGGCTTTACAG

Primer 781 (miMyoT-1366-Forward)
(SEQ ID NO: 11280):
AAAACTCGAGTGAGCGAGGAGATTCAGTGAAA

CTAGAACTGTAAAGCCACAGATGGG

Primer 782 (miMyoT-1366-Reverse)
(SEQ ID NO: 11281):
TTTTACTAGTAGGCAGGGAGATTCAGTGAAAC

TAGAACCCATCTGTGGCTTTACAG

Primer 783 (miMyoT-1490-Forward)
(SEQ ID NO: 11282):
AAAACTCGAGTGAGCGCGAAGAGTTACTTTAC

TGATAACTGTAAAGCCACAGATGGG

Primer 784 (miMyoT-1490-Reverse)
(SEQ ID NO: 11283):
TTTTACTAGTAGGCAGGAAGAGTTACTTTACT

GATAACCCATCTGTGGCTTTACAG

Primer 785 (miMyoT-1603-Forward)
(SEQ ID NO: 11284):
AAAACTCGAGTGAGCGAGCACGTCCAAACCAA

ACTCTTCTGTAAAGCCACAGATGGG

Primer 786 (miMyoT-1603-Reverse)
(SEQ ID NO: 11285):
TTTTACTAGTAGGCAGGCACGTCCAAACCAAA

CTCTTCCCATCTGTGGCTTTACAG
```

DNA encoding a miRNA designated miMyoT-592 was generated using primers 775 and 776. DNA encoding miRNA designated miMyoT-1291 was generated using primers 777 and 778. DNA encoding miRNA designated miMyoT-1321 was generated using primers 779 and 780. DNA encoding miRNA designated miMyoT-1366 was generated using primers 781 and 782. DNA encoding miRNA designated miMyoT-1490 was generated using primers 783 and 784. DNA encoding miRNA designated miMyoT-1603 was generated using primers 785 and 786. The DNAs are set out below, wherein the number in the names indicates the 5' target nucleotide in the myotylin sequence (SEQ ID NO: 11267). See FIG. 1 where the target sequences for the miRNAs in the myotilin sequence are underlined.

```
miMyoT-592
                                (SEQ ID NO: 5)
CTCGAGTGAGCGACCTGATTACAATAGCAGTA

AACTGTAAAGCCACAGATGGGTTTACTGCTAT

TGTAATCAGGCTGCCTACTAGA
```

-continued miMyoT-1291
(SEQ ID NO: 1)
CTCGAGTGAGCGACTGGATGTCCTTGCAAAAG

AACTGTAAAGCCACAGATGGGTTATTTTGCAA

GGACATCCAGCTGCCTACTAGA miMyoT-1321
(SEQ ID NO: 2)
CTCGAGTGAGCGCGCACCAATGTTTATCTACA

AACTGTAAAGCCACAGATGGGTTTGTAGATAA

ACATTGGTGCTTGCCTACTAGA miMyoT-1366
(SEQ ID NO: 3)
CTCGAGTGAGCGAGGAGATTCAGTGAAACTAG

AACTGTAAAGCCACAGATGGGTTCTAGTTTCA

CTGAATCTCCCTGCCTACTAGA miMyoT-1490
(SEQ ID NO: 4)
CTCGAGTGAGCGCGAAGAGTTACTTTACTGAT

AACTGTAAAGCCACAGATGGGTTATCAGTAAA

GTAACTCTTCCTGCCTACTAGA miMyoT-1603
(SEQ ID NO: 6)
CTCGAGTGAGCGAGCACGTCCAAACCAAACTC

TTCTGTAAAGCCACAGATGGGAAGAGTTTGGT

TTACGTGCCTGCCTACTAGA

FIG. 2 shows the DNA templates miMyoT.1321 and miMyoT.1366 and their corresponding folded and mature miRNAs.

One μg of each primer was added to a 1 cycle primer extension reaction: 95° C. for 5 min.; 94° C. for 2 min.; 52° C. for 1 min.; 72° C. for 15 min.; and then holding at 4° C. The PCR products were cleaned up with the Qiagen QIAquick PCR Purification kit before being digested overnight with XhoI and SpeI restriction enzymes. The digestion product was then run on a 1.5% TBE gel and the band excised and purified using the Qiagen QIAquick Gel Extraction Kit.

The PCR products were ligated to a U6T6 vector (via XhoI and XbaI) overnight. This vector contains a mouse U6 promoter and an RNA polymerase III termination signal (6 thymidine nucleotides). miRNAs are cloned into XhoI+XbaI restriction sites located between the 3' end of the U6 promoter and the termination signal (SpeI on the 3' end of the DNA template for each miRNA has complementary cohesive ends with the XbaI site). The ligation product was transformed into chemically competent E-coli cells with a 42° C. heat shock and incubated at 37° C. shaking for 1 hour before being plated on kanamycin selection plates. The colonies were allowed to grow overnight at 37°. The following day they were mini-prepped and sequenced for accuracy.

Example 2

Real-Time PCR Reaction for Effect of Expression of MYOT miRNAs

Expression of the MYOT target sequence in the presence of the MYOT miRNAs was assayed. A lipofectamine 2000 transfection was done in C2C12 cells in a 12-well, white-walled assay plate. 52,000 cells were transfected with 100 ng of AAV-CMV-mutMyoT and 1500 ng of one of the U6T6 vectors described in Example 1 containing miRNA-encoding DNA. The assay was performed 48 hours later.

The media was removed from the cells and 1 μl of Trizol was added per well. Then the cells were resuspended and the lysates were transferred to 1.5 ml EP tubes. Samples were incubated at room temperature for 5 min and 200 ul chloroform was added. The tubes were shaken vigorously for 15 sec, incubated at room temperature for 3 min and centrifuged at 12,000 g for 15 min at 4° C. Then the aqueous phase was transferred to a fresh tube and 0.5 ml isopropyl alcohol was added. The samples were incubated at room temperature for 10 min and centrifuged at 12,000 g for 10 min at 4° C. The RNA pallet was washed once with 1 ml 75% ethanol and aired dry. 20 ul of RNase-Free water was added to dissolve the pellet and the concentration/purification were measured by Nano-drop. 1.5 ug total RNA was added to cDNA generation reaction: 5° C. for 10 min.; 37° C. for 120 min.; 85° C. for 5 sec and then holding at 4° C. The cDNA products were diluted at 1:10 and 4.5 ul was added to real-time PCR reaction. Human Myotilin was used to check the expression of the MYOT and the relative expression was normalized to mouse GAPDH expression.

U6T6-miMyoT-592 (SEQ ID NO: 5) showed higher expression of MYOT than U6T6-miGFP control. U6T6-miMyoT-1291 (SEQ ID NO: 1) reduced the expression of MYOT to 60%, U6T6-miMyoT-1321 (SEQ ID NO: 2) reduced the expression of MYOT to 19%, U6T6-miMyoT-1366 (SEQ ID NO: 3) reduced the expression of MYOT to 41.7%, U6T6-miMyoT-1490 (SEQ ID NO: 4) reduced the expression of MYOT to 55.3%, U6T6-miMyoT-1603 (SEQ ID NO: 6) reduced the expression of MYOT to 34.9%, when compared to U6T6-miGFP control.

Example 3

Production of rAAV Encoding MYOT MicroRNAs

The U6-miMYOT DNAs were cut from U6T6-miMYOT constructs at EcoRI sites and then respectively cloned into AAV6-hrGFPs to generate rAAV-U6-miMyoT vectors. These rAAV vectors express miRNA and hrGFP Example 4

Western Blot Assay for Effect of Expression of MYOT miRNAs from U6T6 Vectors and rAAV The effect of expression of MYOT miRNAs from the U6T6 vectors described in Example 1 and the rAAV described in Example 3 was assayed by Western blot.

One day before transfection, 293 cells were plated in a 24-well plate at 1.5×10$^5$ cells/well. The cells were then transfected with U6T6-miMyoT (592, 1291, 1321, 1366, 1490 or 1603) using Lipofectamine 2000 (Invitrogen, Cat. No. 11668-019).

Forty-eight hours after transfection, cells were collected and washed with cold PBS once. Seventy μl lysis buffer (137 mM NaCl, 10 mM Tris pH=7.4, 1% NP40) were then added. The cells were resuspended completely and incubated on ice for 30 min. The samples were centrifuged for 20 min at 13,000 rpm at 4° C. and the supernatant was collected. The cell lysate was diluted 5-fold for the Lowry protein concentration assay (Bio-Rad Dc Protein Assay Reagent A, B, S; Cat. No. 500-0113, 500-0114, 500-115). Twenty μg of each sample was taken and 2× sample buffer (100 mM Tris pH=6.8, 100 mM DTT, 10% glycerol, 2% SDS, 0.006% bromophenol blue) was added. The samples were boiled for 10 min and then put on ice.

The samples were loaded onto a 10% polyacrylamide gel (based on 37.5:1 acrylamide:bis acrylamide ratio, Bio-Rad, Cat. No. 161-0158), 15 μg on a gel for each sample. Proteins were transferred to PVDF membranes at 15 V for 1 h using semi-dry transfer (Trans-Blot SD Semi-Dry Transfer Cell, Bio-Rad, Cat. No. 170-3940). The blots were placed into blocking buffer (5% non-fat dry milk, 30 mM Tris pH=7.5, 150 mM NaCl, 0.05% Tween-20) and agitated for 1 h at room temperature. The blocking buffer was decanted and anti-myotilin primary antibody solution (rabbit polyclonal generated by Bethyl Laboratories using a peptide corresponding to myotilin residues 473-488) was added and incubated with agitation overnight at 4° C. The membranes were then washed for 30 min, changing the wash buffer (150 mM NaCl, 30 mM Tris pH=7.5, 0.05% Tween-20) every 10 min. Peroxidase-conjugated Goat Anti-Mouse Antibody (Jackson ImmunoReserch, Cat. No. 115-035-146, 1: 100, 000) was added and incubated at room temperature for 2 h. The membranes were then washed for 30 min, changing the wash buffer every 10 min. The blots were placed in chemiluminescent working solution (Immobilon Weatern Chemiluminescent HRP Substrate, Millipore, Cat. No. WBKLS0500), incubated with agitation for 5 min at room temperature, and then exposed to X-ray film.

The membranes were washed for 20 min, changing the wash buffer every 10 min. Next, stripping buffer (2% SDS, 62.5 mM Tris pH=6.7, 100 mM b-ME) was added to the blots and incubated at 50° C. for 30 min. The membranes were washed again for 30 min, changing the wash buffer every 10 min. Then, the membranes were blocked again and re-probed with Anti-GAPDH primary antibody solution (Chemicon, Cat. No. MAB374, 1:200) and peroxidase-conjugated Goat Anti-Mouse Antibody (Jackson ImmunoReserch, Cat. No. 115-035-146, 1:100,000) was used as secondary antibody.

The film was scanned and the density ratio of MYOT to GAPDH was caculated. Compared to U6T6-miGFP control, the expression of MYOT was higher (1.08) in samples of U6T6-miMyoT-592 (SEQ ID NO: 5) and the the expression of MYOT was reduced to 78.9% by U6T6-miMyoT-1291 (SEQ ID NO: 1), 50.2% by U6T6-miMyoT-1321 (SEQ ID NO: 2), 60.2% by U6T6-miMyoT-1366 (SEQ ID NO: 3), 76.2% by U6T6-miMyoT-1490 (SEQ ID NO: 4), 87% by U6T6-miMyoT-1603 (SEQ ID NO: 6).

U6T6-miMYOT-1321 most effectively knocked down myotilin expression both in the real-time PCR and western-blot experiments. The knockdown effect by AAV-miMyoT-1321 was also confirmed by western-blot experiment.

Example 5

Delivery to Newborn Mice

The PCR genotype of newborn pups was determined to identify female WT or T57I MYOT mice (using human MYOT primers and Y chromosome primers). Bilateral intramuscular injections of 5×10$^{10}$ AAV6.miMYOT-1321 or control AAV6.miGFP particles per leg in 1-2 day old mice were sufficient to saturate the lower limb musculature.

Phenotypic correction was then determined initially by histological analyses. Specifically, 3 months after viral delivery, muscles were harvested and cryopreserved. Ten micron serial cryosections were cut and stained with anti-bodies to detect myotilin-positive protein aggregates in T57I myofibers. AAV6.miMYOT-1321 muscles had significantly reduced numbers of aggregates per section compared to AAV6.miGFP or untreated controls. In addition, when AAV6.miMYOT-132-treated muscles did show occasional aggregates, they were significantly smaller than those seen in control-treated or untreated T57I animals. AAV6.miMYOT-132 treatment also improved muscle size deficits relative to the control treatment.

Figure 3B:
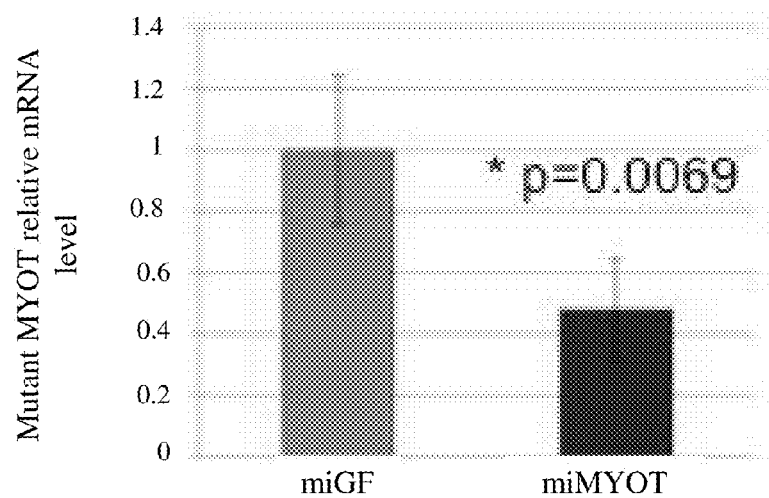

MYOT knockdown was confirmed by Western blot and real-time PCR as shown in FIGS. 3A and 3B. The AAV delivered miMYOT-1321 significantly reduced mutant MYOT protein (FIG. 3A) and mRNA (FIG. 3B) in the muscles.

These results support therapeutic efficacy. Continuing experiments include determining the functional effects of MYOT knockdown in whole muscles by measuring EDL specific force.

Example 6

Delivery to Adult Mice

The PCR genotype of weanlings is determined, and 3-month old or 9-month old mice which have significant pre-existing LGMD1A-associated pathology are chosen for treatment. 5×10$^{10}$ AAV6 vectors are delivered to lower limb musculature by isolated leg perfusion. Phenotypic correction (including hindlimb grip strength, gross muscle parameters and EDL specific force are then measured using various methods over the following months.

Male P1 or P2 mice were injected in the lower limbs with 5×10$^{10}$ DNAse resistant particles AAV6.miMYOT.1321 or control AAV6.miGFP particles per leg. Muscles were harvested for analysis at 3 months and 9 months of age. All mouse protocols were approved by the Institutional Animal Care and Use Committee (IACUC) at The Research Institute of Nationwide Children's Hospital.

Imaging and Histology.

In vivo AAV transduction was determined by GFP epifluorescence using a fluorescent dissecting microscope (MZ16FA, Leica, Wetzlar, Germany). Dissected muscles were placed in O.C.T. Compound (Tissue-Tek, Torrance, Calif.) and frozen in liquid nitrogen-cooled 2-methylbutane. The blocks were cut onto slides as 10 μm cryosections, and stained with hematoxylin and eosin (H&E; following standard protocols), or anti-MYOT polyclonal antibodies. For MYOT immunohistochemistry, cryosections were fixed in methanol and blocked in GFTP$^+$ buffer (5% normal goat serum, 0.1% pig gelatin, 1% BSA, 0.2% Triton X-100, in phosphate-buffered saline). Slides were incubated overnight at 4° C. with MYOT primary antibody (1:400), and then with AlexaFluor-594 conjugated goat anti-rabbit secondary antibodies (1:500; 1 hour at RT; Molecular Probes, Carlsbad, Calif.). Images were taken from mouse tissue harvested from 3- and 9-month old male mice. Muscle cross-sectional fiber diameters and percentage of myofibers with centrally-located nuclei were determined as previously described from five different animals per group (five fields per leg).

Contractile Measurements of Gastrocnemius Muscle.

Mice were anesthetized with intraperitoneal injection of Avertin (250 mg/kg) with supplemental injections given to maintain an adequate level of anesthesia during the whole procedure. The gastrocnemius muscle was exposed and the distal tendon was isolated and cut. The exposed muscle and tendon were kept moist by periodic applications of isotonic saline. Knot was tied at the proximal end of the tendon and the mouse was placed on a heated platform maintained at 37° C. The tendon was tied securely to the lever arm of a servomotor (6650LR, Cambridge Technology) via the suture ends. The muscle was then stimulated with 0.2 ms pulses via the peroneal nerve using platinum electrodes. Stimulation voltage and muscle length were adjusted for maximum isometric twitch force (Pt). The muscle was stimulated at increasing frequencies until a maximum force (Po) was reached at optimal muscle length (Lo). Optimum fiber length (Lf) was determined by multiplying Lo by the gastrocnemius Lf/Lo ratio of 0.45. Total fiber CSA was calculated by dividing the muscle mass (mg) by the product of muscle fiber length (mm) and the density of mammalian skeletal muscle, 1.06 g/cm2. Specific Po (N/cm2) was calculated by dividing Po by total fiber CSA for each muscle. Immediately after muscle mass was measured, muscles were coated in tissue freezing medium (Triangle Biomedical Sciences, Durham, N.C.), frozen in isopentane cooled by dry ice, and stored at −80° C. until needed.

EDL Muscle Contractile Measurements (Supplemental Data).

The EDL muscle was completely removed from the animal and the proximal and distal tendons of the muscle were tied with suture. The muscle was immersed in a bath containing Krebs' mammalian Ringer solution with 0.25 mM tubocurarine chloride. The solution was maintained at 25° C. and bubbled with 95% $O_2$ and 5% $CO_2$. The distal tendon was attached to a servomotor (model 305B, Aurora Scientific, Aurora, ON). The proximal tendon was attached to a force transducer (model BG-50, Kulite Semiconductor Products, Leonia, N.J.). The muscle was stimulated by square-wave pulses delivered by two platinum electrodes connected to a high-power biphasic current stimulator (model 701B, Aurora Scientific, Aurora, ON). The voltage of pulses was increased, and optimal muscle length ($L_o$) was subsequently adjusted to produce maximum twitch force. Muscles were held at $L_o$ and stimulus frequency was increased until the $P_o$ was achieved. The $sP_o$ was determined by dividing $P_o$ by the cross-sectional area (CSA). The $L_f$-to-$L_o$ ratios of 0.44 for EDL muscles was used to calculate $L_f$. The physiological CSA of muscles was determined by dividing the mass of the muscle by the product of $L_f$ and 1.06 g/cm³, the density of mammalian skeletal muscle.

Statistical Analysis.

All data are expressed as mean±SEM. Statistical analyses were performed using the GraphPad Prizm software package. Statistical tests used for each experiment, and accompanying N's, are indicated in the Figure Legends.

MYOT Knockdown Improved Histopathology and Muscle Weight in 3-Month (3-Mo) Old TgT57I Mice TgT57I mice recapitulate the progressive MYOT protein aggregation defects that characterize LGMD1A. In 3 mo-old TgT57I mice, aggregates are associated with additional generalized muscle pathology, including deficits in myofiber size and gastrocnemius muscle weight, as well as slight but significant increase in myofibers with centrally located nuclei, which is a histological indicator that muscles underwent degeneration and were subsequently repaired. Importantly, these phenotypes are useful outcome measures for RNAi therapy. We therefore examined the effects of miMYOT-mediated MYOT gene silencing on aggregate formation, myofiber diameter, muscle weight, and central nuclei defects associated with LGMD1A in young adult TgT57I mice.

Aggregate accumulation was examined by staining AAV6.miMYOT- and AAV6.control-treated TgT57I gastrocnemius muscle cryosections with MYOT immunoreactive antibodies, trichrome, and hematoxylin and eosin (H&E) (FIGS. 4A and B). Microscopic image analysis showed that MYOT knockdown significantly reduced the abundance of protein aggregates by 69% in 3-mo old TgT57I gastrocnemius muscles (FIGS. 4B and C).

Next, the impact of MYOT inhibition on cross-sectional myofiber size was determined using H&E stained muscle cryosections. Myofibers from AAV.control-treated TgT57I muscles were significantly smaller (49.9 μm average diameter; p<0.05) than those from either wild-type group (57.0 μm and 57.7 μm in wild-type mice receiving miMYOT or miGFP, respectively; FIG. 4D). In contrast, MYOT knockdown by our therapeutic AAV6.miMYOT vectors improved average myofiber diameter in TgT57I mice by 4.9 μm (a 9.8% improvement), to levels not significantly different than wild-type (54.8 μm in AAV6.miMYOT-treated TgT57I mice; FIG. 4D). This improvement in myofiber size defects evident at the cellular level translated to whole muscle as well. Indeed, weights of AAV6.miMYOT-treated TgT57I gastrocnemius muscles were not significantly different than those measured in wild-type treated controls, while TgT57I muscles that received control AAV6.miGFP vector weighed an average of 15.9 mg less (11% decrease) than their wild-type counterparts (p<0.001; FIG. 4E). Finally, comparing the AAV6.miMYOT- and AAV6.miGFP-treated TgT57I animals, that MYOT knockdown improved 3-mo TgT57I gastrocnemius muscle weight by an average of 9.5 mg, representing a significant 7.1% improvement (p<0.001).

As a final measure of the effects of MYOT knockdown on LGMD1A-associated histopathology in 3-mo old TgT57I mice, the percentage of myofibers containing centrally-located nuclei was quantified. Typically ~98-99% of myonuclei in uninjured wild-type muscles are localized to the cell periphery. Consistent with this, gastrocnemius muscles from our AAV6.miMYOT- and AAV6.miGFP-treated wild-type animals showed 1.1% and 1.9% central nuclei, respectively. In contrast, 7.7% of 3-mo TgT57I myofibers from control AAV6.miGFP-treated gastrocnemius muscles contained central nuclei. This value is consistent with mild degeneration and regeneration in dystrophic animals. Importantly, MYOT knockdown by AAV6.miMYOT reduced the percentage of myofibers with central nuclei to 3.6% in TgT57I mice, representing a significant 2.1-fold decrease (p<0.001; FIG. 4F).

MYOT knockdown also improves histopathology, muscle weight, and specific force in 9-mo old TgT57I mice Gastrocnemius is among the most severely involved muscles in TgT57I mice and LGMD1A patients. Considering this, prospective LGMD1A-targeted therapies should ideally treat gastrocnemius muscle weakness related to mutant MYOT accumulation. Although 3-mo old TgT57I muscles display LGMD1A-associated changes in histology and weight, our pilot studies showed that significant muscle weakness did not manifest until later in adulthood (9 months of age; data not shown). Therefore, a second cohort of animals were treated with with AAV6.miMYOT.1321 or control AAV6.miLacZ vectors for 9 months, with the goal of correcting whole muscle functional deficits in aged TgT57I gastrocnemius muscles.

Before measuring specific force, MYOT suppression by AAV6.miMYOT (79% mRNA; 63% protein; FIG. 1c) was confirmed to be still benefiting TgT57I animals at 9-months of age, using the outcome measures established in our younger, 3-mo cohort. AAV6.miMYOT-treated TgT57I animals showed significant correction by all measures, compared to AAV6.miLacZ control-treated counterparts. Specifically, in 9-mo old AAV6.miMYOT-treated TgT57I animals, aggregates were reduced by 52% (p<0.01); myofibers were 9.1 µm (20%) larger (54 µm average versus 44.9 µm average in AAV6.miLacZ-treated TgT57I; p<0); gastrocnemius muscles weighed 12% more (116 mg average versus 101 mg average in AAV6.miLacZ-treated TgT57I; p>0.002); and central nuclei were reduced 1.5-fold (10.6% in AAV6.miMYOT-treated versus 15.5% in AAV6.miLacZ-treated TgT57I; p<0.04). The improvements afforded by AAV6.miMYOT were partial, as TgT57I animals treated with this therapeutic vector were still significantly different from wild-type groups using all outcome measures at 9-mos (FIGS. 5A, 5B, 5C, 5D, 5E and 5F).

Figure 6A:
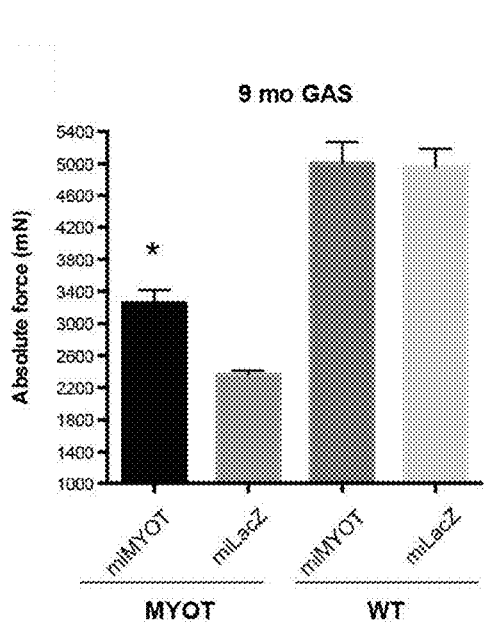
FIGS. 6A and 6B show AAV.miMYO.1321 (labeled miMYOT in the figure) significantly improves whole muscle strength in TgT57I mice 9 months after treatment. AAV.miMYOT-treated TgT57I GAS muscles showed statistically significant 38% and 25% improvements in absolute force (FIG. 6A) and specific force (FIG. 6B) compared to AAV.miLacZ-treated controls (N=6-8 legs; p=0.02 for (a) and p=0.0009 for (b), t-test). Both TgT57I groups were significantly weaker than their WT counterparts (p<0.0001, t-test), while wild-type groups were not significantly different from one another.
Figure 6B:
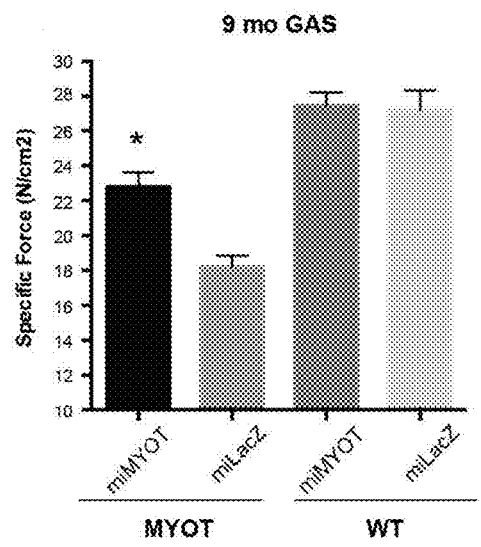

Importantly, MYOT knockdown by AAV6.miMYOT caused significant functional improvement in Tg57I gastrocnemius muscles, as determined by whole muscle physiology tests. Specifically, MYOT knockdown improved absolute and specific force in 9-mo TgT57I gastrocnemius muscles by 38% and 25%, respectively (FIGS. 5A, 5B, 5C, 5D, 5E and 5F). As with the other outcome measures described above, this represented a partial functional recovery, as both groups of TgT57I animals were significantly different from their wild-type treated counterparts (FIGS. 6A and 6B).

Example 7

Dose Escalation and Self-Complementary AAV (scAAV) Vectors

The U6.miMYOT.1321 construct was inserted in a scAAV-6 vector [McCarty et al., *Gene Therapy*, 8(16): 1248-1254 (2001)]. The U6.mi1321 sequence was PCR amplified from the original single-stranded AAV backbone using PCR primers designed with SpeI sites to each end. This U6.miMYOT.1321 sequence flanked by SpeI sites was then ligated into the scAAV-6 backbone at the SpeI site.

An IM dose escalation ($3 \times 10^9$, $3 \times 10^{10}$, $1 \times 10^{11}$, $1 \times 10^{12}$ DRP) of scAAV.miMYOT.1321 was then performed in wild-type mouse muscle to define a preliminary toxic threshold. Animals receiving doses less than $1 \times 10^{12}$ (that is, $1 \times 10^{11}$, $3 \times 10^{10}$, $3 \times 10^9$) showed no to very little evidence of inflammatory response or overt muscle damage, indicating that doses below $1 \times 10^{12}$ are safe using this delivery route.

Next, $1 \times 10^{11}$ DRP of ss and scAAV.miMYOT were administered to contralateral legs of adult T57I mice, and MYOT protein expression was compared by Western blot 4 weeks later. Adult mice were injected into the left TA muscle with $1 \times 10^{11}$ DRP of single-stranded or self-comp AAV6.miMYOT. The contralateral leg functioned as an uninjected control. Identical doses of scAAV.miMYOT vectors doubled MYOT silencing compared to ssAAV vectors, supporting that dose escalation can safely increase knockdown and may subsequently improve correction in T57I mice.

Example 8

Recombinant AAV Encoding miRNAs with Base Pair Mismatches

Three miMYOT miRNAs were made that are predicted to have fewer binding sites on transcripts in both the mouse and human genome, compared to the miMYOT-1321 sequence. Each miRNA includes a single base pair mismatch as shown in the right hand side of FIG. 7 by a yellow line between the mismatched nucleotides.

```
miMYOT-1043
                               (SEQ ID NO: 11286)
CTCGAGTGAGCGATGCCAGAGAACATGTCGAT

TGCCGTAAAGCCACAGATGGGTAATCGACATG

TTCTCTGGCACCGCCTACTAGA miMYOT-1044
                               (SEQ ID NO: 11287)
CTCGAGTGAGCGCGCCAGAGAACATGTCGATT

GACCGTAAAGCCACAGATGGGTTAATCGACAT

GTTCTCTGGCACGCCTACTAGA miMYOT-1634
                               (SEQ ID NO: 11288)
CTCGAGTGAGCGCAGCAGTTACGGGTTCGACT

AACTGTAAAGCCACAGATGGGTTGGTCGAACC

CGTAACTGCTTCGCCTACTAGA
```

The miRNAs were generated by PCR by the methods similar to those described in Example 1. The PCR primers used had the following sequences.

```
Primer 904 (miMYOT-1043-Forward)
                               (SEQ ID NO: 11289)
AAAACTCGAGTGAGCGATGCCAGAGAACATGT

CGATTGCCGTAAAGCCACAGATGGG

Primer 905 (miMYOT-1044-Reverse)
                               (SEQ ID NO: 11290)
AAAAACTAGTAGGCGGTGCCAGAGAACATGTC

GATTACCCATCTGTGGCTTTACGG

Primer 906 (miMYOT-1044-Forward)
                               (SEQ ID NO: 11291)
AAAACTCGAGTGAGCGCGCCAGAGAACATGTC

GATTGACCGTAAAGCCACAGATGGG

Primer 907 (miMYOT-1044-Reverse)
                               (SEQ ID NO: 11292)
AAAAACTAGTAGGCGTGCCAGAGAACATGTCG

ATTAACCCATCTGTGGCTTTACGG

Primer 902 (miMYOT-1634-Forward)
                               (SEQ ID NO: 11293)
AAAACTCGAGTGAGCGCAGCAGTTACGGGTTC

GACTAACTGTAAAGCCACAGATGGG

Primer 903 (miMYOT-1634-Reverse)
                               (SEQ ID NO: 11294)
AAAAACTAGTAGGCGAAGCAGTTACGGGTTCG

ACCAACCCATCTGTGGCTTTACAG
``` scAAV encoding the miRNAs were then made. The scAAV.miMYOT.1321 vector described in Example 7 was digested with SpeI and NotI to remove the U6.miMYOT.1321 sequence. SpeI and NotI restriction sites were added to the tMCK promoter by PCR with primers containing the sites. The tMCK promoter PCR product was ligated then ligated into the same sites in the digested U6.miMYOT.1321 vector, resulting in a scAAV vector containing the tMCK promoter but with no miRNA sequences (scAAV.tMCK). To add miRNAs, double-stranded DNA oligonucleotides containing miRNA sequences were designed with XhoI and EcoRI sites, and subcloned into the XhoI and EcoRI sites of the pSM2/CMV vector (www.addgene.org/17389/). This subcloning step added pri-mir-30 flanking sequences to the respective miRNAs. The miRNAs in pSM2/CMV were then PCR amplified using primers containing NotI and SacII sites, and subcloned into the same sites located after the tMCK promoter in the scAAV.tMCK vector. The scAAV including a genome encoding the MYOT miRNA set out in SEQ ID NO: 11286 was named "scAAV-tMCK-miMyoT-1043", the rAAV including a genome encoding the MYOT miRNA set out in SEQ ID NO: 11287 was named "scAAV-tMCK-iMyoT-1044") and the rAAV including a genome encoding the MYOT miRNA set out in SEQ ID NO: 11288 was named "AAV-tMCK-miMyoT-1634."

Figure 7:
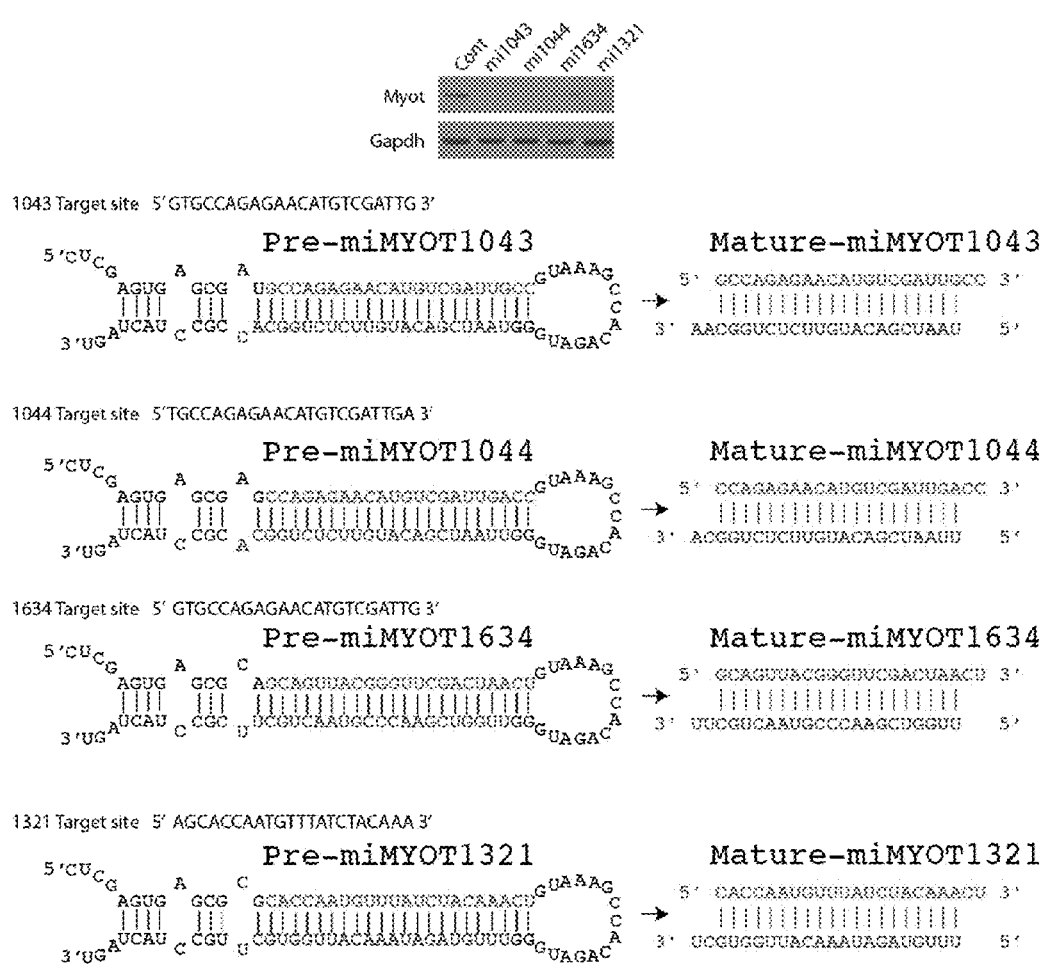
FIG. 7 shows precursor and mature forms of miRNAs miMYOT-1043 (SEQ ID NO: 11286), miMYOT-1044 (SEQ ID NO: 11287), miMYOT-1634 (SEQ ID NO: 11288) and miMYOT-1321 (SEQ ID NO: 2), as well as a Western blot showing each miRNA reduces MyoT protein in vitro to levels similar to the miMYOT-1321 miRNA.

The effect of the three miRNAs on MyoT expression in cells was examined. HEK293 cells were co-transfected with plasmids expressing human myotilin and the U6.miMYOT sequences using Lipofectamine-2000. Protein was harvested from cells the next day using M-PER buffer, quantified by Lowry assay, and then resolved with SDS-PAGE electrophoresis. Protein was transferred to PVDF membrane and blots were incubated with anti-MYOT and anti-GAPDH (loading control) antibodies, followed by HRP-coupled secondary antibodies and development on film using chemiluminescence. FIG. 7 includes a Western blot showing each miRNA reduces MyoT protein to levels similar to the miMYOT-1321 miRNA.

While the present invention has been described in terms of specific embodiments, it is understood that variations and modifications will occur to those skilled in the art. Accordingly, only such limitations as appear in the claims should be placed on the invention.

All documents referred to in this application are hereby incorporated by reference in their entirety.

SEQUENCE LISTING (11294 sequences)

SEQ ID NO: 1 - DNA, 86 bp, Artificial Sequence
  Synthetic primer
ctcgagtgagcgactggatgtccttgcaaaagaactgtaaagccacagatgggttattttgcaaggacatccagctgcctactaga

SEQ ID NO: 2 - DNA, 86 bp, Artificial Sequence
  Synthetic primer
ctcgagtgagcgcgcaccaatgtttatctacaaactgtaaagccacagatgggtttgtagataaacattggtgcttgcctactaga

SEQ ID NO: 3 - DNA, 86 bp, Artificial Sequence
  Synthetic primer
ctcgagtgagcgaggagattcagtgaaactagaactgtaaagccacagatgggttctagtttcactgaatctccctgcctactaga

SEQ ID NO: 4 - DNA, 86 bp, Artificial Sequence
  Synthetic primer
ctcgagtgagcgcgaagagttactttactgataactgtaaagccacagatgggttatcagtaaagtaactcttcctgcctactaga

SEQ ID NO: 5 - DNA, 86 bp, Artificial Sequence
  Synthetic primer
ctcgagtgagcgacctgattacaatagcagtaaactgtaaagccacagatgggtttactgctattgtaatcaggctgcctactaga

SEQ ID NO: 6 - DNA, 84 bp, Artificial Sequence
  Synthetic primer
ctcgagtgagcgagcacgtccaaaccaaactcttctgtaaagccacagatgggaagagtttggtttacgtgcctgcctactaga

SEQ ID NO: 7 - RNA, 19 nt, Homo sapiens
uccguuuuaaauauuugaa

SEQ ID NO: 8 - RNA, 19 nt, Homo sapiens
ccguuuuaaauauuugaau

SEQ ID NO: 9 - RNA, 19 nt, Homo sapiens
cguuuuaaauauuugaauu

SEQ ID NO: 10 - RNA, 19 nt, Homo sapiens
guuuuaaauauuugaauuu

SEQ ID NO: 11 - RNA, 19 nt, Homo sapiens
uuuuaaauauuugaauuuu

SEQ ID NO: 12 - RNA, 19 nt, Homo sapiens
uuuaaauauuugaauuuua

SEQ ID NO: 13 - RNA, 19 nt, Homo sapiens
uuaaauauuugaauuuuau

SEQ ID NO: 14 - RNA, 19 nt, Homo sapiens
uaaauauuugaauuuuauu

SEQ ID NO: 15 - RNA, 19 nt, Homo sapiens
aaauauuugaauuuuauuu

SEQ ID NO: 16 - RNA, 19 nt, Homo sapiens
aauauuugaauuuuauuuu

SEQ ID NO: 17 - RNA, 19 nt, Homo sapiens
auauuugaauuuuauuuuc

SEQ ID NO: 18 - RNA, 19 nt, Homo sapiens
uauuugaauuuuauuuucu

SEQ ID NO: 19 - RNA, 19 nt, Homo sapiens
auuugaauuuuauuuucuu

SEQ ID NO: 20 - RNA, 19 nt, Homo sapiens
uuugaauuuuauuuucuuu

SEQ ID NO: 21 - RNA, 19 nt, Homo sapiens
uugaauuuuauuuucuuuu

SEQ ID NO: 22 - RNA, 19 nt, Homo sapiens
ugaauuuuauuuucuuuug

SEQ ID NO: 23 - RNA, 19 nt, Homo sapiens
gaauuuuauuuucuuuuga

SEQ ID NO: 24 - RNA, 19 nt, Homo sapiens
aauuuuauuuucuuuugac

SEQ ID NO: 25 - RNA, 19 nt, Homo sapiens
auuuuauuuucuuuugaca

SEQ ID NO: 26 - RNA, 19 nt, Homo sapiens
uuuuauuuucuuuugacau

SEQ ID NO: 27 - RNA, 19 nt, Homo sapiens
uuuauuuucuuuugacaua

SEQ ID NO: 28 - RNA, 19 nt, Homo sapiens
uuauuuucuuuugacauac

SEQ ID NO: 29 - RNA, 19 nt, Homo sapiens
uauuuucuuuugacauaca

SEQ ID NO: 30 - RNA, 19 nt, Homo sapiens
auuuucuuuugacauacaa

SEQ ID NO: 31 - RNA, 19 nt, Homo sapiens
uuuucuuuugacauacaac

SEQ ID NO: 32 - RNA, 19 nt, Homo sapiens
uuucuuuugacauacaacu

SEQ ID NO: 33 - RNA, 19 nt, Homo sapiens
uucuuuugacauacaacug

SEQ ID NO: 34 - RNA, 19 nt, Homo sapiens
ucuuuugacauacaacugu

SEQ ID NO: 35 - RNA, 19 nt, Homo sapiens
cuuuugacauacaacugug

SEQ ID NO: 36 - RNA, 19 nt, Homo sapiens
uuuugacauacaacugugg

SEQ ID NO: 37 - RNA, 19 nt, Homo sapiens
uuugacauacaacugugga

SEQ ID NO: 38 - RNA, 19 nt, Homo sapiens
uugacauacaacuguggaa

SEQ ID NO: 39 - RNA, 19 nt, Homo sapiens
ugacauacaacuguggaac

SEQ ID NO: 40 - RNA, 19 nt, Homo sapiens
gacauacaacuguggaaca

SEQ ID NO: 41 - RNA, 19 nt, Homo sapiens
acauacaacuguggaacac

SEQ ID NO: 42 - RNA, 19 nt, Homo sapiens
cauacaacuguggaacacu

SEQ ID NO: 43 - RNA, 19 nt, Homo sapiens
auacaacuguggaacacuc

SEQ ID NO: 44 - RNA, 19 nt, Homo sapiens
uacaacuguggaacacuca

SEQ ID NO: 45 - RNA, 19 nt, Homo sapiens
acaacuguggaacacucag

SEQ ID NO: 46 - RNA, 19 nt, Homo sapiens
caacuguggaacacucaga

SEQ ID NO: 47 - RNA, 19 nt, Homo sapiens
aacuguggaacacucagau

SEQ ID NO: 48 - RNA, 19 nt, Homo sapiens
acuguggaacacucagaua

SEQ ID NO: 49 - RNA, 19 nt, Homo sapiens
cuguggaacacucagauaa

SEQ ID NO: 50 - RNA, 19 nt, Homo sapiens
uguggaacacucagauaau

SEQ ID NO: 51 - RNA, 19 nt, Homo sapiens
guggaacacucagauaauc

SEQ ID NO: 52 - RNA, 19 nt, Homo sapiens
uggaacacucagauaaucu

SEQ ID NO: 53 - RNA, 19 nt, Homo sapiens
ggaacacucagauaaucua

SEQ ID NO: 54 - RNA, 19 nt, Homo sapiens
gaacacucagauaaucuau

SEQ ID NO: 55 - RNA, 19 nt, Homo sapiens
aacacucagauaaucuaua

SEQ ID NO: 56 - RNA, 19 nt, Homo sapiens
acacucagauaaucuauac

SEQ ID NO: 57 - RNA, 19 nt, Homo sapiens
cacucagauaaucuauacc

SEQ ID NO: 58 - RNA, 19 nt, Homo sapiens
acucagauaaucuauacca

SEQ ID NO: 59 - RNA, 19 nt, Homo sapiens
cucagauaaucuauaccau

SEQ ID NO: 60 - RNA, 19 nt, Homo sapiens
ucagauaaucuauaccaug

SEQ ID NO: 61 - RNA, 19 nt, Homo sapiens
cagauaaucuauaccaugu

SEQ ID NO: 62 - RNA, 19 nt, Homo sapiens
agauaaucuauaccauguu

SEQ ID NO: 63 - RNA, 19 nt, Homo sapiens
gauaaucuauaccauguua

SEQ ID NO: 64 - RNA, 19 nt, Homo sapiens
auaaucuauaccauguuag

SEQ ID NO: 65 - RNA, 19 nt, Homo sapiens
uaaucuauaccauguuagu

SEQ ID NO: 66 - RNA, 19 nt, Homo sapiens
aaucuauaccauguuagua

SEQ ID NO: 67 - RNA, 19 nt, Homo sapiens
aucuauaccauguuaguau

SEQ ID NO: 68 - RNA, 19 nt, Homo sapiens
ucuauaccauguuaguauu

SEQ ID NO: 69 - RNA, 19 nt, Homo sapiens
cuauaccauguuaguauuc

SEQ ID NO: 70 - RNA, 19 nt, Homo sapiens
uauaccauguuaguauucc

SEQ ID NO: 71 - RNA, 19 nt, Homo sapiens
auaccauguuaguauuccu

SEQ ID NO: 72 - RNA, 19 nt, Homo sapiens
uaccauguuaguauuccua

SEQ ID NO: 73 - RNA, 19 nt, Homo sapiens
accauguuaguauuccuac

SEQ ID NO: 74 - RNA, 19 nt, Homo sapiens
ccauguuaguauuccuaca

SEQ ID NO: 75 - RNA, 19 nt, Homo sapiens
cauguuaguauuccuacaa

SEQ ID NO: 76 - RNA, 19 nt, Homo sapiens
auguuaguauuccuacaag

SEQ ID NO: 77 - RNA, 19 nt, Homo sapiens
uguuaguauuccuacaaga

SEQ ID NO: 78 - RNA, 19 nt, Homo sapiens
guuaguauuccuacaagag

SEQ ID NO: 79 - RNA, 19 nt, Homo sapiens
uuaguauuccuacaagaga

SEQ ID NO: 80 - RNA, 19 nt, Homo sapiens
uaguauuccuacaagagaa

SEQ ID NO: 81 - RNA, 19 nt, Homo sapiens
aguauuccuacaagagaaa

SEQ ID NO: 82 - RNA, 19 nt, Homo sapiens
guauuccuacaagagaaaa

SEQ ID NO: 83 - RNA, 19 nt, Homo sapiens
uauuccuacaagagaaaac

SEQ ID NO: 84 - RNA, 19 nt, Homo sapiens
auuccuacaagagaaaacg

SEQ ID NO: 85 - RNA, 19 nt, Homo sapiens
uuccuacaagagaaaacgg

SEQ ID NO: 86 - RNA, 19 nt, Homo sapiens
uccuacaagagaaaacggg

SEQ ID NO: 87 - RNA, 19 nt, Homo sapiens
ccuacaagagaaaacgggu

SEQ ID NO: 88 - RNA, 19 nt, Homo sapiens
cuacaagagaaaacgggua

SEQ ID NO: 89 - RNA, 19 nt, Homo sapiens
uacaagagaaaacggguaa

SEQ ID NO: 90 - RNA, 19 nt, Homo sapiens
acaagagaaaacggguaaa

SEQ ID NO: 91 - RNA, 19 nt, Homo sapiens
caagagaaaacggguaaaa

SEQ ID NO: 92 - RNA, 19 nt, Homo sapiens
aagagaaaacggguaaaac

SEQ ID NO: 93 - RNA, 19 nt, Homo sapiens
agagaaaacggguaaaaca

SEQ ID NO: 94 - RNA, 19 nt, Homo sapiens
gagaaaacggguaaaacag

SEQ ID NO: 95 - RNA, 19 nt, Homo sapiens
agaaaacggguaaaacagu

SEQ ID NO: 96 - RNA, 19 nt, Homo sapiens
gaaaacggguaaaacagua

SEQ ID NO: 97 - RNA, 19 nt, Homo sapiens
aaaacggguaaaacaguau

SEQ ID NO: 98 - RNA, 19 nt, Homo sapiens
aaacggguaaaacaguauu

SEQ ID NO: 99 - RNA, 19 nt, Homo sapiens
aacggguaaaacaguauuu

SEQ ID NO: 100 - RNA, 19 nt, Homo sapiens
acggguaaaacaguauuua

SEQ ID NO: 101 - RNA, 19 nt, Homo sapiens
cggguaaaacaguauuuag

SEQ ID NO: 102 - RNA, 19 nt, Homo sapiens
ggguaaaacaguauuuaga

SEQ ID NO: 103 - RNA, 19 nt, Homo sapiens
gguaaaacaguauuuagaa

SEQ ID NO: 104 - RNA, 19 nt, Homo sapiens
guaaaacaguauuuagaaa

SEQ ID NO: 105 - RNA, 19 nt, Homo sapiens
uaaaacaguauuuagaaag

SEQ ID NO: 106 - RNA, 19 nt, Homo sapiens
aaaacaguauuuagaaagc

SEQ ID NO: 107 - RNA, 19 nt, Homo sapiens
aaacaguauuuagaaagca

SEQ ID NO: 108 - RNA, 19 nt, Homo sapiens
aacaguauuuagaaagcag

SEQ ID NO: 109 - RNA, 19 nt, Homo sapiens
acaguauuuagaaagcagu

SEQ ID NO: 110 - RNA, 19 nt, Homo sapiens
caguauuuagaaagcagua

SEQ ID NO: 111 - RNA, 19 nt, Homo sapiens
aguauuuagaaagcaguac

SEQ ID NO: 112 - RNA, 19 nt, Homo sapiens
guauuuagaaagcaguacc

SEQ ID NO: 113 - RNA, 19 nt, Homo sapiens
uauuuagaaagcaguacca

SEQ ID NO: 114 - RNA, 19 nt, Homo sapiens
auuuagaaagcaguaccag

SEQ ID NO: 115 - RNA, 19 nt, Homo sapiens
uuuagaaagcaguaccagu

SEQ ID NO: 116 - RNA, 19 nt, Homo sapiens
uuagaaagcaguaccagua

SEQ ID NO: 117 - RNA, 19 nt, Homo sapiens
uagaaagcaguaccaguaa

SEQ ID NO: 118 - RNA, 19 nt, Homo sapiens
agaaagcaguaccaguaaa

SEQ ID NO: 119 - RNA, 19 nt, Homo sapiens
gaaagcaguaccaguaaac

SEQ ID NO: 120 - RNA, 19 nt, Homo sapiens
aaagcaguaccaguaaacg

SEQ ID NO: 121 - RNA, 19 nt, Homo sapiens
aagcaguaccaguaaacgu

SEQ ID NO: 122 - RNA, 19 nt, Homo sapiens
agcaguaccaguaaacguu

SEQ ID NO: 123 - RNA, 19 nt, Homo sapiens
gcaguaccaguaaacguua

SEQ ID NO: 124 - RNA, 19 nt, Homo sapiens
caguaccaguaaacguuau

SEQ ID NO: 125 - RNA, 19 nt, Homo sapiens
aguaccaguaaacguuauu

SEQ ID NO: 126 - RNA, 19 nt, Homo sapiens
guaccaguaaacguuauua

SEQ ID NO: 127 - RNA, 19 nt, Homo sapiens
uaccaguaaacguuauuac

SEQ ID NO: 128 - RNA, 19 nt, Homo sapiens
accaguaaacguuauuaca

SEQ ID NO: 129 - RNA, 19 nt, Homo sapiens
ccaguaaacguuauuacaa

SEQ ID NO: 130 - RNA, 19 nt, Homo sapiens
caguaaacguuauuacaag

SEQ ID NO: 131 - RNA, 19 nt, Homo sapiens
aguaaacguuauuacaagc

SEQ ID NO: 132 - RNA, 19 nt, Homo sapiens
guaaacguuauuacaagca

SEQ ID NO: 133 - RNA, 19 nt, Homo sapiens
uaaacguuauuacaagcau

SEQ ID NO: 134 - RNA, 19 nt, Homo sapiens
aaacguuauuacaagcauu

SEQ ID NO: 135 - RNA, 19 nt, Homo sapiens
aacguuauuacaagcauua

SEQ ID NO: 136 - RNA, 19 nt, Homo sapiens
acguuauuacaagcauuag

SEQ ID NO: 137 - RNA, 19 nt, Homo sapiens
cguuauuacaagcauuaga

SEQ ID NO: 138 - RNA, 19 nt, Homo sapiens
guuauuacaagcauuagau

SEQ ID NO: 139 - RNA, 19 nt, Homo sapiens
uuauuacaagcauuagaug

SEQ ID NO: 140 - RNA, 19 nt, Homo sapiens
uauuacaagcauuagaugu

SEQ ID NO: 141 - RNA, 19 nt, Homo sapiens
auuacaagcauuagaugug

SEQ ID NO: 142 - RNA, 19 nt, Homo sapiens
uuacaagcauuagaugugu

SEQ ID NO: 143 - RNA, 19 nt, Homo sapiens
uacaagcauuagauguguu

SEQ ID NO: 144 - RNA, 19 nt, Homo sapiens
acaagcauuagauguguuu

SEQ ID NO: 145 - RNA, 19 nt, Homo sapiens
caagcauuagauguguuua

SEQ ID NO: 146 - RNA, 19 nt, Homo sapiens
aagcauuagauguguuuaa

SEQ ID NO: 147 - RNA, 19 nt, Homo sapiens
agcauuagauguguuuaaa

SEQ ID NO: 148 - RNA, 19 nt, Homo sapiens
gcauuagauguguuuaaaa

SEQ ID NO: 149 - RNA, 19 nt, Homo sapiens
cauuagauguguuuaaaaa

SEQ ID NO: 150 - RNA, 19 nt, Homo sapiens
auuagauguguuuaaaaag

SEQ ID NO: 151 - RNA, 19 nt, Homo sapiens
uuagauguguuuaaaaagu

SEQ ID NO: 152 - RNA, 19 nt, Homo sapiens
uagauguguuuaaaaaguu

SEQ ID NO: 153 - RNA, 19 nt, Homo sapiens
agauguguuuaaaaaguug

SEQ ID NO: 154 - RNA, 19 nt, Homo sapiens
gauguguuuaaaaaguuga

SEQ ID NO: 155 - RNA, 19 nt, Homo sapiens
auguguuuaaaaaguugau

SEQ ID NO: 156 - RNA, 19 nt, Homo sapiens
uguguuuaaaaaguugaua

SEQ ID NO: 157 - RNA, 19 nt, Homo sapiens
guguuuaaaaaguugauac

SEQ ID NO: 158 - RNA, 19 nt, Homo sapiens
uguuuaaaaaguugauacu

SEQ ID NO: 159 - RNA, 19 nt, Homo sapiens
guuuaaaaaguugauacua

SEQ ID NO: 160 - RNA, 19 nt, Homo sapiens
uuuaaaaaguugauacuaa

SEQ ID NO: 161 - RNA, 19 nt, Homo sapiens
uuaaaaaguugauacuaau

SEQ ID NO: 162 - RNA, 19 nt, Homo sapiens
uaaaaaguugauacuaauu

SEQ ID NO: 163 - RNA, 19 nt, Homo sapiens
aaaaaguugauacuaauuu

SEQ ID NO: 164 - RNA, 19 nt, Homo sapiens
aaaaguugauacuaauuua

SEQ ID NO: 165 - RNA, 19 nt, Homo sapiens
aaaguugauacuaauuuau

SEQ ID NO: 166 - RNA, 19 nt, Homo sapiens
aaguugauacuaauuuaua

SEQ ID NO: 167 - RNA, 19 nt, Homo sapiens
aguugauacuaauuuauaa

SEQ ID NO: 168 - RNA, 19 nt, Homo sapiens
guugauacuaauuuauaac

SEQ ID NO: 169 - RNA, 19 nt, Homo sapiens
uugauacuaauuuauaacc

SEQ ID NO: 170 - RNA, 19 nt, Homo sapiens
ugauacuaauuuauaaccu

SEQ ID NO: 171 - RNA, 19 nt, Homo sapiens
gauacuaauuuauaaccug

SEQ ID NO: 172 - RNA, 19 nt, Homo sapiens
auacuaauuuauaaccugu

SEQ ID NO: 173 - RNA, 19 nt, Homo sapiens
uacuaauuuauaaccugua

SEQ ID NO: 174 - RNA, 19 nt, Homo sapiens
acuaauuuauaaccuguaa

SEQ ID NO: 175 - RNA, 19 nt, Homo sapiens
cuaauuuauaaccuguaau

SEQ ID NO: 176 - RNA, 19 nt, Homo sapiens
uaauuuauaaccuguaauu

SEQ ID NO: 177 - RNA, 19 nt, Homo sapiens
aauuuauaaccuguaauug

SEQ ID NO: 178 - RNA, 19 nt, Homo sapiens
auuuauaaccuguaauugu

SEQ ID NO: 179 - RNA, 19 nt, Homo sapiens
uuuauaaccuguaauuguu

SEQ ID NO: 180 - RNA, 19 nt, Homo sapiens
uuauaaccuguaauuguua

SEQ ID NO: 181 - RNA, 19 nt, Homo sapiens
uauaaccuguaauuguuaa

SEQ ID NO: 182 - RNA, 19 nt, Homo sapiens
auaaccuguaauuguuaaa

SEQ ID NO: 183 - RNA, 19 nt, Homo sapiens
uaaccuguaauuguuaaau

SEQ ID NO: 184 - RNA, 19 nt, Homo sapiens
aaccuguaauuguuaaaug

SEQ ID NO: 185 - RNA, 19 nt, Homo sapiens
accuguaauuguuaaaugu

SEQ ID NO: 186 - RNA, 19 nt, Homo sapiens
ccuguaauuguuaaaugug

SEQ ID NO: 187 - RNA, 19 nt, Homo sapiens
cuguaauuguuaaaugugc

SEQ ID NO: 188 - RNA, 19 nt, Homo sapiens
uguaauuguuaaaugugca

SEQ ID NO: 189 - RNA, 19 nt, Homo sapiens
guaauuguuaaaugugcau

SEQ ID NO: 190 - RNA, 19 nt, Homo sapiens
uaauuguuaaaugugcaug

SEQ ID NO: 191 - RNA, 19 nt, Homo sapiens
aauuguuaaaugugcauga

SEQ ID NO: 192 - RNA, 19 nt, Homo sapiens
auuguuaaaugugcaugac

SEQ ID NO: 193 - RNA, 19 nt, Homo sapiens
uuguuaaaugugcaugacu

SEQ ID NO: 194 - RNA, 19 nt, Homo sapiens
uguuaaaugugcaugacuu

SEQ ID NO: 195 - RNA, 19 nt, Homo sapiens
guuaaaugugcaugacuua

SEQ ID NO: 196 - RNA, 19 nt, Homo sapiens
uuaaaugugcaugacuuaa

SEQ ID NO: 197 - RNA, 19 nt, Homo sapiens
uaaaugugcaugacuuaaa

SEQ ID NO: 198 - RNA, 19 nt, Homo sapiens
aaaugugcaugacuuaaau

SEQ ID NO: 199 - RNA, 19 nt, Homo sapiens
aaugugcaugacuuaaaug

SEQ ID NO: 200 - RNA, 19 nt, Homo sapiens
augugcaugacuuaaaugu

SEQ ID NO: 201 - RNA, 19 nt, Homo sapiens
ugugcaugacuuaaauguu

SEQ ID NO: 202 - RNA, 19 nt, Homo sapiens
gugcaugacuuaaauguua

SEQ ID NO: 203 - RNA, 19 nt, Homo sapiens
ugcaugacuuaaauguuaa

SEQ ID NO: 204 - RNA, 19 nt, Homo sapiens
gcaugacuuaaauguuaaa

SEQ ID NO: 205 - RNA, 19 nt, Homo sapiens
caugacuuaaauguuaaaa

SEQ ID NO: 206 - RNA, 19 nt, Homo sapiens
augacuuaaauguuaaaau

SEQ ID NO: 207 - RNA, 19 nt, Homo sapiens
ugacuuaaauguuaaaauc

SEQ ID NO: 208 - RNA, 19 nt, Homo sapiens
gacuuaaauguuaaaaucc

SEQ ID NO: 209 - RNA, 19 nt, Homo sapiens
acuuaaauguuaaaauccu

SEQ ID NO: 210 - RNA, 19 nt, Homo sapiens
cuuaaauguuaaaauccug

SEQ ID NO: 211 - RNA, 19 nt, Homo sapiens
uuaaauguuaaaauccugu

SEQ ID NO: 212 - RNA, 19 nt, Homo sapiens
uaaauguuaaaauccugua

SEQ ID NO: 213 - RNA, 19 nt, Homo sapiens
aaauguuaaaauccuguau

SEQ ID NO: 214 - RNA, 19 nt, Homo sapiens
aauguuaaaauccuguauu

SEQ ID NO: 215 - RNA, 19 nt, Homo sapiens
auguuaaaauccuguauuu

SEQ ID NO: 216 - RNA, 19 nt, Homo sapiens
uguuaaaauccuguauuuu

SEQ ID NO: 217 - RNA, 19 nt, Homo sapiens
guuaaaauccuguauuuua

SEQ ID NO: 218 - RNA, 19 nt, Homo sapiens
uuaaaauccuguauuuuaa

SEQ ID NO: 219 - RNA, 19 nt, Homo sapiens
uaaaauccuguauuuuaag

SEQ ID NO: 220 - RNA, 19 nt, Homo sapiens
aaaauccuguauuuuaaga

SEQ ID NO: 221 - RNA, 19 nt, Homo sapiens
aaauccuguauuuuaagau

SEQ ID NO: 222 - RNA, 19 nt, Homo sapiens
aauccuguauuuuaagaua

SEQ ID NO: 223 - RNA, 19 nt, Homo sapiens
auccuguauuuuaagauag

SEQ ID NO: 224 - RNA, 19 nt, Homo sapiens
uccuguauuuuaagauagu

SEQ ID NO: 225 - RNA, 19 nt, Homo sapiens
ccuguauuuuaagauaguc

SEQ ID NO: 226 - RNA, 19 nt, Homo sapiens
cuguauuuuaagauagucu

SEQ ID NO: 227 - RNA, 19 nt, Homo sapiens
uguauuuuaagauagucuu

SEQ ID NO: 228 - RNA, 19 nt, Homo sapiens
guauuuuaagauagucuuc

SEQ ID NO: 229 - RNA, 19 nt, Homo sapiens
uauuuuaagauagucuucu

SEQ ID NO: 230 - RNA, 19 nt, Homo sapiens
auuuuaagauagucuucug

SEQ ID NO: 231 - RNA, 19 nt, Homo sapiens
uuuuaagauagucuucugc

SEQ ID NO: 232 - RNA, 19 nt, Homo sapiens
uuuaagauagucuucugca

SEQ ID NO: 233 - RNA, 19 nt, Homo sapiens
uuaagauagucuucugcag

SEQ ID NO: 234 - RNA, 19 nt, Homo sapiens
uaagauagucuucugcagu

SEQ ID NO: 235 - RNA, 19 nt, Homo sapiens
aagauagucuucugcaguu

SEQ ID NO: 236 - RNA, 19 nt, Homo sapiens
agauagucuucugcaguua

SEQ ID NO: 237 - RNA, 19 nt, Homo sapiens
gauagucuucugcaguuac

SEQ ID NO: 238 - RNA, 19 nt, Homo sapiens
auagucuucugcaguuaca

SEQ ID NO: 239 - RNA, 19 nt, Homo sapiens
uagucuucugcaguuacaa

SEQ ID NO: 240 - RNA, 19 nt, Homo sapiens
agucuucugcaguuacaaa

SEQ ID NO: 241 - RNA, 19 nt, Homo sapiens
gucuucugcaguuacaaau

SEQ ID NO: 242 - RNA, 19 nt, Homo sapiens
ucuucugcaguuacaaauc

SEQ ID NO: 243 - RNA, 19 nt, Homo sapiens
cuucugcaguuacaaaucc

SEQ ID NO: 244 - RNA, 19 nt, Homo sapiens
uucugcaguuacaaaucca

SEQ ID NO: 245 - RNA, 19 nt, Homo sapiens
ucugcaguuacaaauccau

SEQ ID NO: 246 - RNA, 19 nt, Homo sapiens
cugcaguuacaaauccaua

SEQ ID NO: 247 - RNA, 19 nt, Homo sapiens
ugcaguuacaaauccauau

SEQ ID NO: 248 - RNA, 19 nt, Homo sapiens
gcaguuacaaauccauaua

SEQ ID NO: 249 - RNA, 19 nt, Homo sapiens
caguuacaaauccauauac

SEQ ID NO: 250 - RNA, 19 nt, Homo sapiens
aguuacaaauccauauacc

SEQ ID NO: 251 - RNA, 19 nt, Homo sapiens
guuacaaauccauauaccc

SEQ ID NO: 252 - RNA, 19 nt, Homo sapiens
uuacaaauccauauaccca

SEQ ID NO: 253 - RNA, 19 nt, Homo sapiens
uacaaauccauauacccag

SEQ ID NO: 254 - RNA, 19 nt, Homo sapiens
acaaauccauauacccaga

SEQ ID NO: 255 - RNA, 19 nt, Homo sapiens
caaauccauauacccagau

SEQ ID NO: 256 - RNA, 19 nt, Homo sapiens
aaauccauauacccagauu

SEQ ID NO: 257 - RNA, 19 nt, Homo sapiens
aauccauauacccagauuu

SEQ ID NO: 258 - RNA, 19 nt, Homo sapiens
auccauauacccagauuuc

SEQ ID NO: 259 - RNA, 19 nt, Homo sapiens
uccauauacccagauuucc

SEQ ID NO: 260 - RNA, 19 nt, Homo sapiens
ccauauacccagauuuccu

SEQ ID NO: 261 - RNA, 19 nt, Homo sapiens
cauauacccagauuuccug

SEQ ID NO: 262 - RNA, 19 nt, Homo sapiens
auauacccagauuuccugu

SEQ ID NO: 263 - RNA, 19 nt, Homo sapiens
uauacccagauuuccugua

SEQ ID NO: 264 - RNA, 19 nt, Homo sapiens
auacccagauuuccuguag

SEQ ID NO: 265 - RNA, 19 nt, Homo sapiens
uacccagauuuccuguagg

SEQ ID NO: 266 - RNA, 19 nt, Homo sapiens
acccagauuuccuguaggc

SEQ ID NO: 267 - RNA, 19 nt, Homo sapiens
cccagauuuccuguaggcu

SEQ ID NO: 268 - RNA, 19 nt, Homo sapiens
ccagauuuccuguaggcuu

SEQ ID NO: 269 - RNA, 19 nt, Homo sapiens
cagauuuccuguaggcuuc

SEQ ID NO: 270 - RNA, 19 nt, Homo sapiens
agauuuccuguaggcuuca

SEQ ID NO: 271 - RNA, 19 nt, Homo sapiens
gauuuccuguaggcuucac

SEQ ID NO: 272 - RNA, 19 nt, Homo sapiens
auuuccuguaggcuucaca

SEQ ID NO: 273 - RNA, 19 nt, Homo sapiens
uuuccuguaggcuucacaa

SEQ ID NO: 274 - RNA, 19 nt, Homo sapiens
uuccuguaggcuucacaaa

SEQ ID NO: 275 - RNA, 19 nt, Homo sapiens
uccuguaggcuucacaaau

SEQ ID NO: 276 - RNA, 19 nt, Homo sapiens
ccuguaggcuucacaaauc

SEQ ID NO: 277 - RNA, 19 nt, Homo sapiens
cuguaggcuucacaaaucg

SEQ ID NO: 278 - RNA, 19 nt, Homo sapiens
uguaggcuucacaaaucgg

SEQ ID NO: 279 - RNA, 19 nt, Homo sapiens
guaggcuucacaaaucgga

SEQ ID NO: 280 - RNA, 19 nt, Homo sapiens
uaggcuucacaaaucggag

SEQ ID NO: 281 - RNA, 19 nt, Homo sapiens
aggcuucacaaaucggagg

SEQ ID NO: 282 - RNA, 19 nt, Homo sapiens
ggcuucacaaaucggaggg

SEQ ID NO: 283 - RNA, 19 nt, Homo sapiens
gcuucacaaaucggagggg

SEQ ID NO: 284 - RNA, 19 nt, Homo sapiens
cuucacaaaucggaggggu

SEQ ID NO: 285 - RNA, 19 nt, Homo sapiens
uucacaaaucggaggggua

SEQ ID NO: 286 - RNA, 19 nt, Homo sapiens
ucacaaaucggagggguac

SEQ ID NO: 287 - RNA, 19 nt, Homo sapiens
cacaaaucggagggguaca

SEQ ID NO: 288 - RNA, 19 nt, Homo sapiens
acaaaucggagggguacau

SEQ ID NO: 289 - RNA, 19 nt, Homo sapiens
caaaucggagggguacaua

SEQ ID NO: 290 - RNA, 19 nt, Homo sapiens
aaaucggagggguacauag

SEQ ID NO: 291 - RNA, 19 nt, Homo sapiens
aaucggagggguacauaga

SEQ ID NO: 292 - RNA, 19 nt, Homo sapiens
aucggagggguacauagaa

SEQ ID NO: 293 - RNA, 19 nt, Homo sapiens
ucggagggguacauagaau

SEQ ID NO: 294 - RNA, 19 nt, Homo sapiens
cggagggguacauagaaug

SEQ ID NO: 295 - RNA, 19 nt, Homo sapiens
ggagggguacauagaaugu

SEQ ID NO: 296 - RNA, 19 nt, Homo sapiens
gagggguacauagaaugug

SEQ ID NO: 297 - RNA, 19 nt, Homo sapiens
agggguacauagaaugugc

SEQ ID NO: 298 - RNA, 19 nt, Homo sapiens
gggguacauagaaugugca

SEQ ID NO: 299 - RNA, 19 nt, Homo sapiens
ggguacauagaaugugcaa

SEQ ID NO: 300 - RNA, 19 nt, Homo sapiens
gguacauagaaugugcaag

SEQ ID NO: 301 - RNA, 19 nt, Homo sapiens
guacauagaaugugcaaga

SEQ ID NO: 302 - RNA, 19 nt, Homo sapiens
uacauagaaugugcaagag

SEQ ID NO: 303 - RNA, 19 nt, Homo sapiens
acauagaaugugcaagagu

SEQ ID NO: 304 - RNA, 19 nt, Homo sapiens
cauagaaugugcaagaguc

SEQ ID NO: 305 - RNA, 19 nt, Homo sapiens
auagaaugugcaagaguca

SEQ ID NO: 306 - RNA, 19 nt, Homo sapiens
uagaaugugcaagagucaa

SEQ ID NO: 307 - RNA, 19 nt, Homo sapiens
agaaugugcaagagucaaa

SEQ ID NO: 308 - RNA, 19 nt, Homo sapiens
gaaugugcaagagucaaag

SEQ ID NO: 309 - RNA, 19 nt, Homo sapiens
aaugugcaagagucaaagg

SEQ ID NO: 310 - RNA, 19 nt, Homo sapiens
augugcaagagucaaagga

SEQ ID NO: 311 - RNA, 19 nt, Homo sapiens
ugugcaagagucaaaggau

SEQ ID NO: 312 - RNA, 19 nt, Homo sapiens
gugcaagagucaaaggaua

SEQ ID NO: 313 - RNA, 19 nt, Homo sapiens
ugcaagagucaaaggauaa

SEQ ID NO: 314 - RNA, 19 nt, Homo sapiens
gcaagagucaaaggauaaa

SEQ ID NO: 315 - RNA, 19 nt, Homo sapiens
caagagucaaaggauaaau

SEQ ID NO: 316 - RNA, 19 nt, Homo sapiens
aagagucaaaggauaaaua

SEQ ID NO: 317 - RNA, 19 nt, Homo sapiens
agagucaaaggauaaauaa

SEQ ID NO: 318 - RNA, 19 nt, Homo sapiens
gagucaaaggauaaauaau

SEQ ID NO: 319 - RNA, 19 nt, Homo sapiens
agucaaaggauaaauaaua

SEQ ID NO: 320 - RNA, 19 nt, Homo sapiens
gucaaaggauaaauaauau

SEQ ID NO: 321 - RNA, 19 nt, Homo sapiens
ucaaaggauaaauaauauu

SEQ ID NO: 322 - RNA, 19 nt, Homo sapiens
caaaggauaaauaauauua

SEQ ID NO: 323 - RNA, 19 nt, Homo sapiens
aaaggauaaauaauauuau

SEQ ID NO: 324 - RNA, 19 nt, Homo sapiens
aaggauaaauaauauuaua

SEQ ID NO: 325 - RNA, 19 nt, Homo sapiens
aggauaaauaauauuauaa

SEQ ID NO: 326 - RNA, 19 nt, Homo sapiens
ggauaaauaauauuauaaa

SEQ ID NO: 327 - RNA, 19 nt, Homo sapiens
gauaaauaauauuauaaau

SEQ ID NO: 328 - RNA, 19 nt, Homo sapiens
auaaauaauauuauaaaua

SEQ ID NO: 329 - RNA, 19 nt, Homo sapiens
uaaauaauauuauaaauau

SEQ ID NO: 330 - RNA, 19 nt, Homo sapiens
aaauaauauuauaaauaua

SEQ ID NO: 331 - RNA, 19 nt, Homo sapiens
aauaauauuauaaauauau

SEQ ID NO: 332 - RNA, 19 nt, Homo sapiens
auaauauuauaaauauaua

SEQ ID NO: 333 - RNA, 19 nt, Homo sapiens
uaauauuauaaauauauau

SEQ ID NO: 334 - RNA, 19 nt, Homo sapiens
aauauuauaaauauauauu

SEQ ID NO: 335 - RNA, 19 nt, Homo sapiens
auauuauaaauauauauua

SEQ ID NO: 336 - RNA, 19 nt, Homo sapiens
uauuauaaauauauauuaa

SEQ ID NO: 337 - RNA, 19 nt, Homo sapiens
auuauaaauauauauuaac

SEQ ID NO: 338 - RNA, 19 nt, Homo sapiens
uuauaaauauauauuaacu

SEQ ID NO: 339 - RNA, 19 nt, Homo sapiens
uauaaauauauauuaacua

SEQ ID NO: 340 - RNA, 19 nt, Homo sapiens
auaaauauauauuaacuau

SEQ ID NO: 341 - RNA, 19 nt, Homo sapiens
uaaauauauauuaacuaua

SEQ ID NO: 342 - RNA, 19 nt, Homo sapiens
aaauauauauuaacuauau

SEQ ID NO: 343 - RNA, 19 nt, Homo sapiens
aauauauauuaacuauauu

SEQ ID NO: 344 - RNA, 19 nt, Homo sapiens
auauauauuaacuauauua

SEQ ID NO: 345 - RNA, 19 nt, Homo sapiens
uauauauuaacuauauuac

SEQ ID NO: 346 - RNA, 19 nt, Homo sapiens
auauauuaacuauauuacc

SEQ ID NO: 347 - RNA, 19 nt, Homo sapiens
uauauuaacuauauuaccu

SEQ ID NO: 348 - RNA, 19 nt, Homo sapiens
auauuaacuauauuaccua

SEQ ID NO: 349 - RNA, 19 nt, Homo sapiens
uauuaacuauauuaccuaa

SEQ ID NO: 350 - RNA, 19 nt, Homo sapiens
auuaacuauauuaccuaau

SEQ ID NO: 351 - RNA, 19 nt, Homo sapiens
uuaacuauauuaccuaauu

SEQ ID NO: 352 - RNA, 19 nt, Homo sapiens
uaacuauauuaccuaauua

SEQ ID NO: 353 - RNA, 19 nt, Homo sapiens
aacuauauuaccuaauuaa

SEQ ID NO: 354 - RNA, 19 nt, Homo sapiens
acuauauuaccuaauuaaa

SEQ ID NO: 355 - RNA, 19 nt, Homo sapiens
cuauauuaccuaauuaaaa

SEQ ID NO: 356 - RNA, 19 nt, Homo sapiens
uauauuaccuaauuaaaac

SEQ ID NO: 357 - RNA, 19 nt, Homo sapiens
auauuaccuaauuaaaacc

SEQ ID NO: 358 - RNA, 19 nt, Homo sapiens
uauuaccuaauuaaaacca

SEQ ID NO: 359 - RNA, 19 nt, Homo sapiens
auuaccuaauuaaaaccau

SEQ ID NO: 360 - RNA, 19 nt, Homo sapiens
uuaccuaauuaaaaccaua

SEQ ID NO: 361 - RNA, 19 nt, Homo sapiens
uaccuaauuaaaaccauaa

SEQ ID NO: 362 - RNA, 19 nt, Homo sapiens
accuaauuaaaaccauaau

SEQ ID NO: 363 - RNA, 19 nt, Homo sapiens
ccuaauuaaaaccauaauc

SEQ ID NO: 364 - RNA, 19 nt, Homo sapiens
cuaauuaaaaccauaaucu

SEQ ID NO: 365 - RNA, 19 nt, Homo sapiens
uaauuaaaaccauaaucug

SEQ ID NO: 366 - RNA, 19 nt, Homo sapiens
aauuaaaaccauaaucugu

SEQ ID NO: 367 - RNA, 19 nt, Homo sapiens
auuaaaaccauaaucuguu

SEQ ID NO: 368 - RNA, 19 nt, Homo sapiens
uuaaaaccauaaucuguua

SEQ ID NO: 369 - RNA, 19 nt, Homo sapiens
uaaaaccauaaucuguuaa

SEQ ID NO: 370 - RNA, 19 nt, Homo sapiens
aaaaccauaaucuguuaau

SEQ ID NO: 371 - RNA, 19 nt, Homo sapiens
aaaccauaaucuguuaaua

SEQ ID NO: 372 - RNA, 19 nt, Homo sapiens
aaccauaaucuguuaauac

SEQ ID NO: 373 - RNA, 19 nt, Homo sapiens
accauaaucuguuaauaca

SEQ ID NO: 374 - RNA, 19 nt, Homo sapiens
ccauaaucuguuaauacag

SEQ ID NO: 375 - RNA, 19 nt, Homo sapiens
cauaaucuguuaauacagc

SEQ ID NO: 376 - RNA, 19 nt, Homo sapiens
auaaucuguuaauacagcu

SEQ ID NO: 377 - RNA, 19 nt, Homo sapiens
uaaucuguuaauacagcua

SEQ ID NO: 378 - RNA, 19 nt, Homo sapiens
aaucuguuaauacagcuau

SEQ ID NO: 379 - RNA, 19 nt, Homo sapiens
aucuguuaauacagcuaug

SEQ ID NO: 380 - RNA, 19 nt, Homo sapiens
ucuguuaauacagcuaugg

SEQ ID NO: 381 - RNA, 19 nt, Homo sapiens
cuguuaauacagcuaugga

SEQ ID NO: 382 - RNA, 19 nt, Homo sapiens
uguuaauacagcuauggau

SEQ ID NO: 383 - RNA, 19 nt, Homo sapiens
guuaauacagcuauggauu

SEQ ID NO: 384 - RNA, 19 nt, Homo sapiens
uuaauacagcuauggauua

SEQ ID NO: 385 - RNA, 19 nt, Homo sapiens
uaauacagcuauggauuaa

SEQ ID NO: 386 - RNA, 19 nt, Homo sapiens
aauacagcuauggauuaau

SEQ ID NO: 387 - RNA, 19 nt, Homo sapiens
auacagcuauggauuaauu

SEQ ID NO: 388 - RNA, 19 nt, Homo sapiens
uacagcuauggauuaauuu

SEQ ID NO: 389 - RNA, 19 nt, Homo sapiens
acagcuauggauuaauuuc

SEQ ID NO: 390 - RNA, 19 nt, Homo sapiens
cagcuauggauuaauuuca

SEQ ID NO: 391 - RNA, 19 nt, Homo sapiens
agcuauggauuaauuucaa

SEQ ID NO: 392 - RNA, 19 nt, Homo sapiens
gcuauggauuaauuucaaa

SEQ ID NO: 393 - RNA, 19 nt, Homo sapiens
cuauggauuaauuucaaaa

SEQ ID NO: 394 - RNA, 19 nt, Homo sapiens
uauggauuaauuucaaaaa

SEQ ID NO: 395 - RNA, 19 nt, Homo sapiens
auggauuaauuucaaaaaa

SEQ ID NO: 396 - RNA, 19 nt, Homo sapiens
uggauuaauuucaaaaaaa

SEQ ID NO: 397 - RNA, 19 nt, Homo sapiens
ggauuaauuucaaaaaaau

SEQ ID NO: 398 - RNA, 19 nt, Homo sapiens
gauuaauuucaaaaaaaug

SEQ ID NO: 399 - RNA, 19 nt, Homo sapiens
auuaauuucaaaaaaaugu

SEQ ID NO: 400 - RNA, 19 nt, Homo sapiens
uuaauuucaaaaaaaugua

SEQ ID NO: 401 - RNA, 19 nt, Homo sapiens
uaauuucaaaaaaauguaa

SEQ ID NO: 402 - RNA, 19 nt, Homo sapiens
aauuucaaaaaaauguaau

SEQ ID NO: 403 - RNA, 19 nt, Homo sapiens
auuucaaaaaaauguaauc

SEQ ID NO: 404 - RNA, 19 nt, Homo sapiens
uuucaaaaaaauguaauca

SEQ ID NO: 405 - RNA, 19 nt, Homo sapiens
uucaaaaaaauguaaucaa

SEQ ID NO: 406 - RNA, 19 nt, Homo sapiens
ucaaaaaaauguaaucaaa

SEQ ID NO: 407 - RNA, 19 nt, Homo sapiens
caaaaaaauguaaucaaau

SEQ ID NO: 408 - RNA, 19 nt, Homo sapiens
aaaaaaauguaaucaaaua

SEQ ID NO: 409 - RNA, 19 nt, Homo sapiens
aaaaaauguaaucaaauau

SEQ ID NO: 410 - RNA, 19 nt, Homo sapiens
aaaaauguaaucaaauaua

SEQ ID NO: 411 - RNA, 19 nt, Homo sapiens
aaaauguaaucaaauauau

SEQ ID NO: 412 - RNA, 19 nt, Homo sapiens
aaauguaaucaaauauauu

SEQ ID NO: 413 - RNA, 19 nt, Homo sapiens
aauguaaucaaauauauua

SEQ ID NO: 414 - RNA, 19 nt, Homo sapiens
auguaaucaaauauauuac

SEQ ID NO: 415 - RNA, 19 nt, Homo sapiens
uguaaucaaauauauuacu

SEQ ID NO: 416 - RNA, 19 nt, Homo sapiens
guaaucaaauauauuacua

SEQ ID NO: 417 - RNA, 19 nt, Homo sapiens
uaaucaaauauauuacuaa

SEQ ID NO: 418 - RNA, 19 nt, Homo sapiens
aaucaaauauauuacuaau

SEQ ID NO: 419 - RNA, 19 nt, Homo sapiens
aucaaauauauuacuaaug

SEQ ID NO: 420 - RNA, 19 nt, Homo sapiens
ucaaauauauuacuaaugg

SEQ ID NO: 421 - RNA, 19 nt, Homo sapiens
caaauauauuacuaauggu

SEQ ID NO: 422 - RNA, 19 nt, Homo sapiens
aaauauauuacuaauggug

SEQ ID NO: 423 - RNA, 19 nt, Homo sapiens
aauauauuacuaauggugu

SEQ ID NO: 424 - RNA, 19 nt, Homo sapiens
auauauuacuaauggugua

SEQ ID NO: 425 - RNA, 19 nt, Homo sapiens
uauauuacuaaugguguag

SEQ ID NO: 426 - RNA, 19 nt, Homo sapiens
auauuacuaaugguguagu

SEQ ID NO: 427 - RNA, 19 nt, Homo sapiens
uauuacuaaugguguaguu

SEQ ID NO: 428 - RNA, 19 nt, Homo sapiens
auuacuaaugguguaguug

SEQ ID NO: 429 - RNA, 19 nt, Homo sapiens
uuacuaaugguguaguugg

SEQ ID NO: 430 - RNA, 19 nt, Homo sapiens
uacuaaugguguaguuggc

SEQ ID NO: 431 - RNA, 19 nt, Homo sapiens
acuaaugguguaguuggcu

SEQ ID NO: 432 - RNA, 19 nt, Homo sapiens
cuaaugguguaguuggcug

SEQ ID NO: 433 - RNA, 19 nt, Homo sapiens
uaaugguguaguuggcugu

SEQ ID NO: 434 - RNA, 19 nt, Homo sapiens
aaugguguaguuggcuguu

SEQ ID NO: 435 - RNA, 19 nt, Homo sapiens
augguguaguuggcuguuu

SEQ ID NO: 436 - RNA, 19 nt, Homo sapiens
ugguguaguuggcuguuuu

SEQ ID NO: 437 - RNA, 19 nt, Homo sapiens
gguguaguuggcuguuuuc

SEQ ID NO: 438 - RNA, 19 nt, Homo sapiens
guguaguuggcuguuuucc

SEQ ID NO: 439 - RNA, 19 nt, Homo sapiens
uguaguuggcuguuuucca

SEQ ID NO: 440 - RNA, 19 nt, Homo sapiens
guaguuggcuguuuuccaa

SEQ ID NO: 441 - RNA, 19 nt, Homo sapiens
uaguuggcuguuuuccaau

SEQ ID NO: 442 - RNA, 19 nt, Homo sapiens
aguuggcuguuuuccaaug

SEQ ID NO: 443 - RNA, 19 nt, Homo sapiens
guuggcuguuuuccaaugu

SEQ ID NO: 444 - RNA, 19 nt, Homo sapiens
uuggcuguuuuccaauguu

SEQ ID NO: 445 - RNA, 19 nt, Homo sapiens
uggcuguuuuccaauguug

SEQ ID NO: 446 - RNA, 19 nt, Homo sapiens
ggcuguuuuccaauguugg

SEQ ID NO: 447 - RNA, 19 nt, Homo sapiens
gcuguuuuccaauguuggu

SEQ ID NO: 448 - RNA, 19 nt, Homo sapiens
cuguuuuccaauguuggua

SEQ ID NO: 449 - RNA, 19 nt, Homo sapiens
uguuuuccaauguugguaa

SEQ ID NO: 450 - RNA, 19 nt, Homo sapiens
guuuuccaauguugguaaa

SEQ ID NO: 451 - RNA, 19 nt, Homo sapiens
uuuuccaauguugguaaag

SEQ ID NO: 452 - RNA, 19 nt, Homo sapiens
uuuccaauguugguaaagu

SEQ ID NO: 453 - RNA, 19 nt, Homo sapiens
uuccaauguugguaaaguu

SEQ ID NO: 454 - RNA, 19 nt, Homo sapiens
uccaauguugguaaaguua

SEQ ID NO: 455 - RNA, 19 nt, Homo sapiens
ccaauguugguaaaguuau

SEQ ID NO: 456 - RNA, 19 nt, Homo sapiens
caauguugguaaaguuauu

SEQ ID NO: 457 - RNA, 19 nt, Homo sapiens
aauguugguaaaguuauua

SEQ ID NO: 458 - RNA, 19 nt, Homo sapiens
auguugguaaaguuauuaa

SEQ ID NO: 459 - RNA, 19 nt, Homo sapiens
uguugguaaaguuauuaaa

SEQ ID NO: 460 - RNA, 19 nt, Homo sapiens
guugguaaaguuauuaaag

SEQ ID NO: 461 - RNA, 19 nt, Homo sapiens
uugguaaaguuauuaaagu

SEQ ID NO: 462 - RNA, 19 nt, Homo sapiens
ugguaaaguuauuaaaguu

SEQ ID NO: 463 - RNA, 19 nt, Homo sapiens
gguaaaguuauuaaaguuc

SEQ ID NO: 464 - RNA, 19 nt, Homo sapiens
guaaaguuauuaaaguucu

SEQ ID NO: 465 - RNA, 19 nt, Homo sapiens
uaaaguuauuaaaguucuu

SEQ ID NO: 466 - RNA, 19 nt, Homo sapiens
aaaguuauuaaaguucuuc

SEQ ID NO: 467 - RNA, 19 nt, Homo sapiens
aaguuauuaaaguucuuca

SEQ ID NO: 468 - RNA, 19 nt, Homo sapiens
aguuauuaaaguucuucac

SEQ ID NO: 469 - RNA, 19 nt, Homo sapiens
guuauuaaaguucuucacu

SEQ ID NO: 470 - RNA, 19 nt, Homo sapiens
uuauuaaaguucuucacuu

SEQ ID NO: 471 - RNA, 19 nt, Homo sapiens
uauuaaaguucuucacuuu

SEQ ID NO: 472 - RNA, 19 nt, Homo sapiens
auuaaaguucuucacuuuc

SEQ ID NO: 473 - RNA, 19 nt, Homo sapiens
uuaaaguucuucacuuuca

SEQ ID NO: 474 - RNA, 19 nt, Homo sapiens
uaaaguucuucacuuucau

SEQ ID NO: 475 - RNA, 19 nt, Homo sapiens
aaaguucuucacuuucaua

SEQ ID NO: 476 - RNA, 19 nt, Homo sapiens
aaguucuucacuuucauag

SEQ ID NO: 477 - RNA, 19 nt, Homo sapiens
aguucuucacuuucauaga

SEQ ID NO: 478 - RNA, 19 nt, Homo sapiens
guucuucacuuucauagag

SEQ ID NO: 479 - RNA, 19 nt, Homo sapiens
uucuucacuuucauagagu

SEQ ID NO: 480 - RNA, 19 nt, Homo sapiens
ucuucacuuucauagaguc

SEQ ID NO: 481 - RNA, 19 nt, Homo sapiens
cuucacuuucauagagucc

SEQ ID NO: 482 - RNA, 19 nt, Homo sapiens
uucacuuucauagagucca

SEQ ID NO: 483 - RNA, 19 nt, Homo sapiens
ucacuuucauagaguccag

SEQ ID NO: 484 - RNA, 19 nt, Homo sapiens
cacuuucauagaguccaga

SEQ ID NO: 485 - RNA, 19 nt, Homo sapiens
acuuucauagaguccagau

SEQ ID NO: 486 - RNA, 19 nt, Homo sapiens
cuuucauagaguccagauu

SEQ ID NO: 487 - RNA, 19 nt, Homo sapiens
uuucauagaguccagauug

SEQ ID NO: 488 - RNA, 19 nt, Homo sapiens
uucauagaguccagauuga

SEQ ID NO: 489 - RNA, 19 nt, Homo sapiens
ucauagaguccagauugag

SEQ ID NO: 490 - RNA, 19 nt, Homo sapiens
cauagaguccagauugagc

SEQ ID NO: 491 - RNA, 19 nt, Homo sapiens
auagaguccagauugagcu

SEQ ID NO: 492 - RNA, 19 nt, Homo sapiens
uagaguccagauugagcug

SEQ ID NO: 493 - RNA, 19 nt, Homo sapiens
agaguccagauugagcugc

SEQ ID NO: 494 - RNA, 19 nt, Homo sapiens
gaguccagauugagcugcc

SEQ ID NO: 495 - RNA, 19 nt, Homo sapiens
aguccagauugagcugcca

SEQ ID NO: 496 - RNA, 19 nt, Homo sapiens
guccagauugagcugccaa

SEQ ID NO: 497 - RNA, 19 nt, Homo sapiens
uccagauugagcugccaaa

SEQ ID NO: 498 - RNA, 19 nt, Homo sapiens
ccagauugagcugccaaac

SEQ ID NO: 499 - RNA, 19 nt, Homo sapiens
cagauugagcugccaaacg

SEQ ID NO: 500 - RNA, 19 nt, Homo sapiens
agauugagcugccaaacgc

SEQ ID NO: 501 - RNA, 19 nt, Homo sapiens
gauugagcugccaaacgcu

SEQ ID NO: 502 - RNA, 19 nt, Homo sapiens
auugagcugccaaacgcug

SEQ ID NO: 503 - RNA, 19 nt, Homo sapiens
uugagcugccaaacgcuga

SEQ ID NO: 504 - RNA, 19 nt, Homo sapiens
ugagcugccaaacgcugaa

SEQ ID NO: 505 - RNA, 19 nt, Homo sapiens
gagcugccaaacgcugaaa

SEQ ID NO: 506 - RNA, 19 nt, Homo sapiens
agcugccaaacgcugaaau

SEQ ID NO: 507 - RNA, 19 nt, Homo sapiens
gcugccaaacgcugaaauu

SEQ ID NO: 508 - RNA, 19 nt, Homo sapiens
cugccaaacgcugaaauuc

SEQ ID NO: 509 - RNA, 19 nt, Homo sapiens
ugccaaacgcugaaauucu

SEQ ID NO: 510 - RNA, 19 nt, Homo sapiens
gccaaacgcugaaauucuc

SEQ ID NO: 511 - RNA, 19 nt, Homo sapiens
ccaaacgcugaaauucucc

SEQ ID NO: 512 - RNA, 19 nt, Homo sapiens
caaacgcugaaauucuccu

SEQ ID NO: 513 - RNA, 19 nt, Homo sapiens
aaacgcugaaauucuccuu

SEQ ID NO: 514 - RNA, 19 nt, Homo sapiens
aacgcugaaauucuccuuc

SEQ ID NO: 515 - RNA, 19 nt, Homo sapiens
acgcugaaauucuccuucu

SEQ ID NO: 516 - RNA, 19 nt, Homo sapiens
cgcugaaauucuccuucug

SEQ ID NO: 517 - RNA, 19 nt, Homo sapiens
gcugaaauucuccuucugg

SEQ ID NO: 518 - RNA, 19 nt, Homo sapiens
cugaaauucuccuucuggg

SEQ ID NO: 519 - RNA, 19 nt, Homo sapiens
ugaaauucuccuucugggu

SEQ ID NO: 520 - RNA, 19 nt, Homo sapiens
gaaauucuccuucuggguu

SEQ ID NO: 521 - RNA, 19 nt, Homo sapiens
aaauucuccuucuggguua

SEQ ID NO: 522 - RNA, 19 nt, Homo sapiens
aauucuccuucuggguuaa

SEQ ID NO: 523 - RNA, 19 nt, Homo sapiens
auucuccuucuggguuaaa

SEQ ID NO: 524 - RNA, 19 nt, Homo sapiens
uucuccuucuggguuaaaa

SEQ ID NO: 525 - RNA, 19 nt, Homo sapiens
ucuccuucuggguuaaaag

SEQ ID NO: 526 - RNA, 19 nt, Homo sapiens
cuccuucuggguuaaaagc

SEQ ID NO: 527 - RNA, 19 nt, Homo sapiens
uccuucuggguuaaaagcu

SEQ ID NO: 528 - RNA, 19 nt, Homo sapiens
ccuucuggguuaaaagcuu

SEQ ID NO: 529 - RNA, 19 nt, Homo sapiens
cuucuggguuaaaagcuug

SEQ ID NO: 530 - RNA, 19 nt, Homo sapiens
uucuggguuaaaagcuugu

SEQ ID NO: 531 - RNA, 19 nt, Homo sapiens
ucuggguuaaaagcuuguu

SEQ ID NO: 532 - RNA, 19 nt, Homo sapiens
cuggguuaaaagcuuguuu

SEQ ID NO: 533 - RNA, 19 nt, Homo sapiens
uggguuaaaagcuuguuuu

SEQ ID NO: 534 - RNA, 19 nt, Homo sapiens
ggguuaaaagcuuguuuua

SEQ ID NO: 535 - RNA, 19 nt, Homo sapiens
gguuaaaagcuuguuuuac

SEQ ID NO: 536 - RNA, 19 nt, Homo sapiens
guuaaaagcuuguuuuaca

SEQ ID NO: 537 - RNA, 19 nt, Homo sapiens
uuaaaagcuuguuuuacau

SEQ ID NO: 538 - RNA, 19 nt, Homo sapiens
uaaaagcuuguuuuacauu

SEQ ID NO: 539 - RNA, 19 nt, Homo sapiens
aaaagcuuguuuuacauuc

SEQ ID NO: 540 - RNA, 19 nt, Homo sapiens
aaagcuuguuuuacauuca

SEQ ID NO: 541 - RNA, 19 nt, Homo sapiens
aagcuuguuuuacauucaa

SEQ ID NO: 542 - RNA, 19 nt, Homo sapiens
agcuuguuuuacauucaaa

SEQ ID NO: 543 - RNA, 19 nt, Homo sapiens
gcuuguuuuacauucaaac

SEQ ID NO: 544 - RNA, 19 nt, Homo sapiens
cuuguuuuacauucaaacc

SEQ ID NO: 545 - RNA, 19 nt, Homo sapiens
uuguuuuacauucaaaccu

SEQ ID NO: 546 - RNA, 19 nt, Homo sapiens
uguuuuacauucaaaccuu

SEQ ID NO: 547 - RNA, 19 nt, Homo sapiens
guuuuacauucaaaccuuu

SEQ ID NO: 548 - RNA, 19 nt, Homo sapiens
uuuuacauucaaaccuuuc

SEQ ID NO: 549 - RNA, 19 nt, Homo sapiens
uuuacauucaaaccuuucc

SEQ ID NO: 550 - RNA, 19 nt, Homo sapiens
uuacauucaaaccuuuccc

SEQ ID NO: 551 - RNA, 19 nt, Homo sapiens
uacauucaaaccuuuccca

SEQ ID NO: 552 - RNA, 19 nt, Homo sapiens
acauucaaaccuuucccau

SEQ ID NO: 553 - RNA, 19 nt, Homo sapiens
cauucaaaccuuucccauu

SEQ ID NO: 554 - RNA, 19 nt, Homo sapiens
auucaaaccuuucccauua

SEQ ID NO: 555 - RNA, 19 nt, Homo sapiens
uucaaaccuuucccauuaa

SEQ ID NO: 556 - RNA, 19 nt, Homo sapiens
ucaaaccuuucccauuaag

SEQ ID NO: 557 - RNA, 19 nt, Homo sapiens
caaaccuuucccauuaagu

SEQ ID NO: 558 - RNA, 19 nt, Homo sapiens
aaaccuuucccauuaagug

SEQ ID NO: 559 - RNA, 19 nt, Homo sapiens
aaccuuucccauuaagugc

SEQ ID NO: 560 - RNA, 19 nt, Homo sapiens
accuuucccauuaagugcu

SEQ ID NO: 561 - RNA, 19 nt, Homo sapiens
ccuuucccauuaagugcua

SEQ ID NO: 562 - RNA, 19 nt, Homo sapiens
cuuucccauuaagugcuaa

SEQ ID NO: 563 - RNA, 19 nt, Homo sapiens
uuucccauuaagugcuaaa

SEQ ID NO: 564 - RNA, 19 nt, Homo sapiens
uucccauuaagugcuaaau

SEQ ID NO: 565 - RNA, 19 nt, Homo sapiens
ucccauuaagugcuaaaua

SEQ ID NO: 566 - RNA, 19 nt, Homo sapiens
cccauuaagugcuaaauau

SEQ ID NO: 567 - RNA, 19 nt, Homo sapiens
ccauuaagugcuaaauauu

SEQ ID NO: 568 - RNA, 19 nt, Homo sapiens
cauuaagugcuaaauauuu

SEQ ID NO: 569 - RNA, 19 nt, Homo sapiens
auuaagugcuaaauauuug

SEQ ID NO: 570 - RNA, 19 nt, Homo sapiens
uuaagugcuaaauauuugc

SEQ ID NO: 571 - RNA, 19 nt, Homo sapiens
uaagugcuaaauauuugcu

SEQ ID NO: 572 - RNA, 19 nt, Homo sapiens
aagugcuaaauauuugcug

SEQ ID NO: 573 - RNA, 19 nt, Homo sapiens
agugcuaaauauuugcuga

SEQ ID NO: 574 - RNA, 19 nt, Homo sapiens
gugcuaaauauuugcugaa

SEQ ID NO: 575 - RNA, 19 nt, Homo sapiens
ugcuaaauauuugcugaau

SEQ ID NO: 576 - RNA, 19 nt, Homo sapiens
gcuaaauauuugcugaaug

SEQ ID NO: 577 - RNA, 19 nt, Homo sapiens
cuaaauauuugcugaaugu

SEQ ID NO: 578 - RNA, 19 nt, Homo sapiens
uaaauauuugcugaauguu

SEQ ID NO: 579 - RNA, 19 nt, Homo sapiens
aaauauuugcugaauguug

SEQ ID NO: 580 - RNA, 19 nt, Homo sapiens
aauauuugcugaauguugg

SEQ ID NO: 581 - RNA, 19 nt, Homo sapiens
auauuugcugaauguuggu

SEQ ID NO: 582 - RNA, 19 nt, Homo sapiens
uauuugcugaauguugguc

SEQ ID NO: 583 - RNA, 19 nt, Homo sapiens
auuugcugaauguuggucg

SEQ ID NO: 584 - RNA, 19 nt, Homo sapiens
uuugcugaauguuggucga

SEQ ID NO: 585 - RNA, 19 nt, Homo sapiens
uugcugaauguuggucgaa

SEQ ID NO: 586 - RNA, 19 nt, Homo sapiens
ugcugaauguuggucgaac

SEQ ID NO: 587 - RNA, 19 nt, Homo sapiens
gcugaauguuggucgaacc

SEQ ID NO: 588 - RNA, 19 nt, Homo sapiens
cugaauguuggucgaaccc

SEQ ID NO: 589 - RNA, 19 nt, Homo sapiens
ugaauguuggucgaacccg

SEQ ID NO: 590 - RNA, 19 nt, Homo sapiens
gaauguuggucgaacccgu

SEQ ID NO: 591 - RNA, 19 nt, Homo sapiens
aauguuggucgaacccgua

SEQ ID NO: 592 - RNA, 19 nt, Homo sapiens
auguuggucgaacccguaa

SEQ ID NO: 593 - RNA, 19 nt, Homo sapiens
uguuggucgaacccguaac

SEQ ID NO: 594 - RNA, 19 nt, Homo sapiens
guuggucgaacccguaacu

SEQ ID NO: 595 - RNA, 19 nt, Homo sapiens
uuggucgaacccguaacug

SEQ ID NO: 596 - RNA, 19 nt, Homo sapiens
uggucgaacccguaacugc

SEQ ID NO: 597 - RNA, 19 nt, Homo sapiens
ggucgaacccguaacugcu

SEQ ID NO: 598 - RNA, 19 nt, Homo sapiens
gucgaacccguaacugcuu

SEQ ID NO: 599 - RNA, 19 nt, Homo sapiens
ucgaacccguaacugcuua

SEQ ID NO: 600 - RNA, 19 nt, Homo sapiens
cgaacccguaacugcuuag

SEQ ID NO: 601 - RNA, 19 nt, Homo sapiens
gaacccguaacugcuuagg

SEQ ID NO: 602 - RNA, 19 nt, Homo sapiens
aacccguaacugcuuagga

SEQ ID NO: 603 - RNA, 19 nt, Homo sapiens
acccguaacugcuuaggag

SEQ ID NO: 604 - RNA, 19 nt, Homo sapiens
cccguaacugcuuaggagc

SEQ ID NO: 605 - RNA, 19 nt, Homo sapiens
ccguaacugcuuaggagcu

SEQ ID NO: 606 - RNA, 19 nt, Homo sapiens
cguaacugcuuaggagcug

SEQ ID NO: 607 - RNA, 19 nt, Homo sapiens
guaacugcuuaggagcugg

SEQ ID NO: 608 - RNA, 19 nt, Homo sapiens
uaacugcuuaggagcugga

SEQ ID NO: 609 - RNA, 19 nt, Homo sapiens
aacugcuuaggagcuggaa

SEQ ID NO: 610 - RNA, 19 nt, Homo sapiens
acugcuuaggagcuggaag

SEQ ID NO: 611 - RNA, 19 nt, Homo sapiens
cugcuuaggagcuggaaga

SEQ ID NO: 612 - RNA, 19 nt, Homo sapiens
ugcuuaggagcuggaagag

SEQ ID NO: 613 - RNA, 19 nt, Homo sapiens
gcuuaggagcuggaagagu

SEQ ID NO: 614 - RNA, 19 nt, Homo sapiens
cuuaggagcuggaagaguu

SEQ ID NO: 615 - RNA, 19 nt, Homo sapiens
uuaggagcuggaagaguuu

SEQ ID NO: 616 - RNA, 19 nt, Homo sapiens
uaggagcuggaagaguuug

SEQ ID NO: 617 - RNA, 19 nt, Homo sapiens
aggagcuggaagaguuugg

SEQ ID NO: 618 - RNA, 19 nt, Homo sapiens
ggagcuggaagaguuuggu

SEQ ID NO: 619 - RNA, 19 nt, Homo sapiens
gagcuggaagaguuugguu

SEQ ID NO: 620 - RNA, 19 nt, Homo sapiens
agcuggaagaguuugguuu

SEQ ID NO: 621 - RNA, 19 nt, Homo sapiens
gcuggaagaguuugguuug

SEQ ID NO: 622 - RNA, 19 nt, Homo sapiens
cuggaagaguuugguuugg

SEQ ID NO: 623 - RNA, 19 nt, Homo sapiens
uggaagaguuugguuugga

SEQ ID NO: 624 - RNA, 19 nt, Homo sapiens
ggaagaguuugguuuggac

SEQ ID NO: 625 - RNA, 19 nt, Homo sapiens
gaagaguuugguuuggacg

SEQ ID NO: 626 - RNA, 19 nt, Homo sapiens
aagaguuugguuuggacgu

SEQ ID NO: 627 - RNA, 19 nt, Homo sapiens
agaguuugguuuggacgug

SEQ ID NO: 628 - RNA, 19 nt, Homo sapiens
gaguuugguuuggacgugc

SEQ ID NO: 629 - RNA, 19 nt, Homo sapiens
aguuugguuuggacgugcc

SEQ ID NO: 630 - RNA, 19 nt, Homo sapiens
guuugguuuggacgugccg

SEQ ID NO: 631 - RNA, 19 nt, Homo sapiens
uuugguuuggacgugccgu

SEQ ID NO: 632 - RNA, 19 nt, Homo sapiens
uugguuuggacgugccgua

SEQ ID NO: 633 - RNA, 19 nt, Homo sapiens
ugguuuggacgugccguaa

SEQ ID NO: 634 - RNA, 19 nt, Homo sapiens
gguuuggacgugccguaac

SEQ ID NO: 635 - RNA, 19 nt, Homo sapiens
guuuggacgugccguaacg

SEQ ID NO: 636 - RNA, 19 nt, Homo sapiens
uuuggacgugccguaacgu

SEQ ID NO: 637 - RNA, 19 nt, Homo sapiens
uuggacgugccguaacguc

SEQ ID NO: 638 - RNA, 19 nt, Homo sapiens
uggacgugccguaacgucu

SEQ ID NO: 639 - RNA, 19 nt, Homo sapiens
ggacgugccguaacgucua

SEQ ID NO: 640 - RNA, 19 nt, Homo sapiens
gacgugccguaacgucuaa

SEQ ID NO: 641 - RNA, 19 nt, Homo sapiens
acgugccguaacgucuaau

SEQ ID NO: 642 - RNA, 19 nt, Homo sapiens
cgugccguaacgucuaauc

SEQ ID NO: 643 - RNA, 19 nt, Homo sapiens
gugccguaacgucuaaucu

SEQ ID NO: 644 - RNA, 19 nt, Homo sapiens
ugccguaacgucuaaucuu

SEQ ID NO: 645 - RNA, 19 nt, Homo sapiens
gccguaacgucuaaucuug

SEQ ID NO: 646 - RNA, 19 nt, Homo sapiens
ccguaacgucuaaucuugu

SEQ ID NO: 647 - RNA, 19 nt, Homo sapiens
cguaacgucuaaucuugug

SEQ ID NO: 648 - RNA, 19 nt, Homo sapiens
guaacgucuaaucuugugu

SEQ ID NO: 649 - RNA, 19 nt, Homo sapiens
uaacgucuaaucuuguguu

SEQ ID NO: 650 - RNA, 19 nt, Homo sapiens
aacgucuaaucuuguguua

SEQ ID NO: 651 - RNA, 19 nt, Homo sapiens
acgucuaaucuuguguuac

SEQ ID NO: 652 - RNA, 19 nt, Homo sapiens
cgucuaaucuuguguuaca

SEQ ID NO: 653 - RNA, 19 nt, Homo sapiens
gucuaaucuuguguuacau

SEQ ID NO: 654 - RNA, 19 nt, Homo sapiens
ucuaaucuuguguuacaug

SEQ ID NO: 655 - RNA, 19 nt, Homo sapiens
cuaaucuuguguuacaugu

SEQ ID NO: 656 - RNA, 19 nt, Homo sapiens
uaaucuuguguuacaugua

SEQ ID NO: 657 - RNA, 19 nt, Homo sapiens
aaucuuguguuacauguag

SEQ ID NO: 658 - RNA, 19 nt, Homo sapiens
aucuuguguuacauguagu

SEQ ID NO: 659 - RNA, 19 nt, Homo sapiens
ucuuguguuacauguaguc

SEQ ID NO: 660 - RNA, 19 nt, Homo sapiens
cuuguguuacauguaguca

SEQ ID NO: 661 - RNA, 19 nt, Homo sapiens
uuguguuacauguagucac

SEQ ID NO: 662 - RNA, 19 nt, Homo sapiens
uguguuacauguagucacu

SEQ ID NO: 663 - RNA, 19 nt, Homo sapiens
guguuacauguagucacuc

SEQ ID NO: 664 - RNA, 19 nt, Homo sapiens
uguuacauguagucacucc

SEQ ID NO: 665 - RNA, 19 nt, Homo sapiens
guuacauguagucacucca

SEQ ID NO: 666 - RNA, 19 nt, Homo sapiens
uuacauguagucacuccag

SEQ ID NO: 667 - RNA, 19 nt, Homo sapiens
uacauguagucacuccagc

SEQ ID NO: 668 - RNA, 19 nt, Homo sapiens
acauguagucacuccagcu

SEQ ID NO: 669 - RNA, 19 nt, Homo sapiens
cauguagucacuccagcuu

SEQ ID NO: 670 - RNA, 19 nt, Homo sapiens
auguagucacuccagcuuc

SEQ ID NO: 671 - RNA, 19 nt, Homo sapiens
uguagucacuccagcuuca

SEQ ID NO: 672 - RNA, 19 nt, Homo sapiens
guagucacuccagcuucau

SEQ ID NO: 673 - RNA, 19 nt, Homo sapiens
uagucacuccagcuucauu

SEQ ID NO: 674 - RNA, 19 nt, Homo sapiens
agucacuccagcuucauua

SEQ ID NO: 675 - RNA, 19 nt, Homo sapiens
gucacuccagcuucauuaa

SEQ ID NO: 676 - RNA, 19 nt, Homo sapiens
ucacuccagcuucauuaac

SEQ ID NO: 677 - RNA, 19 nt, Homo sapiens
cacuccagcuucauuaacu

SEQ ID NO: 678 - RNA, 19 nt, Homo sapiens
acuccagcuucauuaacug

SEQ ID NO: 679 - RNA, 19 nt, Homo sapiens
cuccagcuucauuaacugc

SEQ ID NO: 680 - RNA, 19 nt, Homo sapiens
uccagcuucauuaacugcu

SEQ ID NO: 681 - RNA, 19 nt, Homo sapiens
ccagcuucauuaacugcug

SEQ ID NO: 682 - RNA, 19 nt, Homo sapiens
cagcuucauuaacugcuga

SEQ ID NO: 683 - RNA, 19 nt, Homo sapiens
agcuucauuaacugcugac

SEQ ID NO: 684 - RNA, 19 nt, Homo sapiens
gcuucauuaacugcugaca

SEQ ID NO: 685 - RNA, 19 nt, Homo sapiens
cuucauuaacugcugacac

SEQ ID NO: 686 - RNA, 19 nt, Homo sapiens
uucauuaacugcugacaca

SEQ ID NO: 687 - RNA, 19 nt, Homo sapiens
ucauuaacugcugacacag

SEQ ID NO: 688 - RNA, 19 nt, Homo sapiens
cauuaacugcugacacagu

SEQ ID NO: 689 - RNA, 19 nt, Homo sapiens
auuaacugcugacacagua

SEQ ID NO: 690 - RNA, 19 nt, Homo sapiens
uuaacugcugacacaguau

SEQ ID NO: 691 - RNA, 19 nt, Homo sapiens
uaacugcugacacaguaua

SEQ ID NO: 692 - RNA, 19 nt, Homo sapiens
aacugcugacacaguauac

SEQ ID NO: 693 - RNA, 19 nt, Homo sapiens
acugcugacacaguauacc

SEQ ID NO: 694 - RNA, 19 nt, Homo sapiens
cugcugacacaguauacca

SEQ ID NO: 695 - RNA, 19 nt, Homo sapiens
ugcugacacaguauaccac

SEQ ID NO: 696 - RNA, 19 nt, Homo sapiens
gcugacacaguauaccacc

SEQ ID NO: 697 - RNA, 19 nt, Homo sapiens
cugacacaguauaccaccc

SEQ ID NO: 698 - RNA, 19 nt, Homo sapiens
ugacacaguauaccaccca

SEQ ID NO: 699 - RNA, 19 nt, Homo sapiens
gacacaguauaccacccag

SEQ ID NO: 700 - RNA, 19 nt, Homo sapiens
acacaguauaccacccagc

SEQ ID NO: 701 - RNA, 19 nt, Homo sapiens
cacaguauaccacccagca

SEQ ID NO: 702 - RNA, 19 nt, Homo sapiens
acaguauaccacccagcau

SEQ ID NO: 703 - RNA, 19 nt, Homo sapiens
caguauaccacccagcauc

SEQ ID NO: 704 - RNA, 19 nt, Homo sapiens
aguauaccacccagcaucu

SEQ ID NO: 705 - RNA, 19 nt, Homo sapiens
guauaccacccagcaucuu

SEQ ID NO: 706 - RNA, 19 nt, Homo sapiens
uauaccacccagcaucuuu

SEQ ID NO: 707 - RNA, 19 nt, Homo sapiens
auaccacccagcaucuuuc

SEQ ID NO: 708 - RNA, 19 nt, Homo sapiens
uaccacccagcaucuuucu

SEQ ID NO: 709 - RNA, 19 nt, Homo sapiens
accacccagcaucuuucuu

SEQ ID NO: 710 - RNA, 19 nt, Homo sapiens
ccacccagcaucuuucuug

SEQ ID NO: 711 - RNA, 19 nt, Homo sapiens
cacccagcaucuuucuugu

SEQ ID NO: 712 - RNA, 19 nt, Homo sapiens
acccagcaucuuucuuguu

SEQ ID NO: 713 - RNA, 19 nt, Homo sapiens
cccagcaucuuucuuguuu

SEQ ID NO: 714 - RNA, 19 nt, Homo sapiens
ccagcaucuuucuuguuua

SEQ ID NO: 715 - RNA, 19 nt, Homo sapiens
cagcaucuuucuuguuuac

SEQ ID NO: 716 - RNA, 19 nt, Homo sapiens
agcaucuuucuuguuuaca

SEQ ID NO: 717 - RNA, 19 nt, Homo sapiens
gcaucuuucuuguuuacau

SEQ ID NO: 718 - RNA, 19 nt, Homo sapiens
caucuuucuuguuuacauc

SEQ ID NO: 719 - RNA, 19 nt, Homo sapiens
aucuuucuuguuuacaucu

SEQ ID NO: 720 - RNA, 19 nt, Homo sapiens
ucuuucuuguuuacaucuu

SEQ ID NO: 721 - RNA, 19 nt, Homo sapiens
cuuucuuguuuacaucuuu

SEQ ID NO: 722 - RNA, 19 nt, Homo sapiens
uuucuuguuuacaucuuuu

SEQ ID NO: 723 - RNA, 19 nt, Homo sapiens
uucuuguuuacaucuuuua

SEQ ID NO: 724 - RNA, 19 nt, Homo sapiens
ucuuguuuacaucuuuuau

SEQ ID NO: 725 - RNA, 19 nt, Homo sapiens
cuuguuuacaucuuuuauc

SEQ ID NO: 726 - RNA, 19 nt, Homo sapiens
uuguuuacaucuuuuauca

SEQ ID NO: 727 - RNA, 19 nt, Homo sapiens
uguuuacaucuuuuaucag

SEQ ID NO: 728 - RNA, 19 nt, Homo sapiens
guuuacaucuuuuaucagu

SEQ ID NO: 729 - RNA, 19 nt, Homo sapiens
uuuacaucuuuuaucagua

SEQ ID NO: 730 - RNA, 19 nt, Homo sapiens
uuacaucuuuuaucaguaa

SEQ ID NO: 731 - RNA, 19 nt, Homo sapiens
uacaucuuuuaucaguaaa

SEQ ID NO: 732 - RNA, 19 nt, Homo sapiens
acaucuuuuaucaguaaag

SEQ ID NO: 733 - RNA, 19 nt, Homo sapiens
caucuuuuaucaguaaagu

SEQ ID NO: 734 - RNA, 19 nt, Homo sapiens
aucuuuuaucaguaaagua

SEQ ID NO: 735 - RNA, 19 nt, Homo sapiens
ucuuuuaucaguaaaguaa

SEQ ID NO: 736 - RNA, 19 nt, Homo sapiens
cuuuuaucaguaaaguaac

SEQ ID NO: 737 - RNA, 19 nt, Homo sapiens
uuuuaucaguaaaguaacu

SEQ ID NO: 738 - RNA, 19 nt, Homo sapiens
uuuaucaguaaaguaacuc

SEQ ID NO: 739 - RNA, 19 nt, Homo sapiens
uuaucaguaaaguaacucu

SEQ ID NO: 740 - RNA, 19 nt, Homo sapiens
uaucaguaaaguaacucuu

SEQ ID NO: 741 - RNA, 19 nt, Homo sapiens
aucaguaaaguaacucuuc

SEQ ID NO: 742 - RNA, 19 nt, Homo sapiens
ucaguaaaguaacucuucc

SEQ ID NO: 743 - RNA, 19 nt, Homo sapiens
caguaaaguaacucuucca

SEQ ID NO: 744 - RNA, 19 nt, Homo sapiens
aguaaaguaacucuuccag

SEQ ID NO: 745 - RNA, 19 nt, Homo sapiens
guaaaguaacucuuccagu

SEQ ID NO: 746 - RNA, 19 nt, Homo sapiens
uaaaguaacucuuccagug

SEQ ID NO: 747 - RNA, 19 nt, Homo sapiens
aaaguaacucuuccagugu

SEQ ID NO: 748 - RNA, 19 nt, Homo sapiens
aaguaacucuuccaguguu

SEQ ID NO: 749 - RNA, 19 nt, Homo sapiens
aguaacucuuccaguguua

SEQ ID NO: 750 - RNA, 19 nt, Homo sapiens
guaacucuuccaguguuau

SEQ ID NO: 751 - RNA, 19 nt, Homo sapiens
uaacucuuccaguguuauc

SEQ ID NO: 752 - RNA, 19 nt, Homo sapiens
aacucuuccaguguuaucu

SEQ ID NO: 753 - RNA, 19 nt, Homo sapiens
acucuuccaguguuaucuu

SEQ ID NO: 754 - RNA, 19 nt, Homo sapiens
cucuuccaguguuaucuug

SEQ ID NO: 755 - RNA, 19 nt, Homo sapiens
ucuuccaguguuaucuuga

SEQ ID NO: 756 - RNA, 19 nt, Homo sapiens
cuuccaguguuaucuugau

SEQ ID NO: 757 - RNA, 19 nt, Homo sapiens
uuccaguguuaucuugaua

SEQ ID NO: 758 - RNA, 19 nt, Homo sapiens
uccaguguuaucuugauau

SEQ ID NO: 759 - RNA, 19 nt, Homo sapiens
ccaguguuaucuugauaua

SEQ ID NO: 760 - RNA, 19 nt, Homo sapiens
caguguuaucuugauauaa

SEQ ID NO: 761 - RNA, 19 nt, Homo sapiens
aguguuaucuugauauaag

SEQ ID NO: 762 - RNA, 19 nt, Homo sapiens
guguuaucuugauauaagc

SEQ ID NO: 763 - RNA, 19 nt, Homo sapiens
uguuaucuugauauaagcu

SEQ ID NO: 764 - RNA, 19 nt, Homo sapiens
guuaucuugauauaagcuu

SEQ ID NO: 765 - RNA, 19 nt, Homo sapiens
uuaucuugauauaagcuua

SEQ ID NO: 766 - RNA, 19 nt, Homo sapiens
uaucuugauauaagcuuau

SEQ ID NO: 767 - RNA, 19 nt, Homo sapiens
aucuugauauaagcuuauu

SEQ ID NO: 768 - RNA, 19 nt, Homo sapiens
ucuugauauaagcuuauuc

SEQ ID NO: 769 - RNA, 19 nt, Homo sapiens
cuugauauaagcuuauucg

SEQ ID NO: 770 - RNA, 19 nt, Homo sapiens
uugauauaagcuuauucgg

SEQ ID NO: 771 - RNA, 19 nt, Homo sapiens
ugauauaagcuuauucggu

SEQ ID NO: 772 - RNA, 19 nt, Homo sapiens
gauauaagcuuauucgguc

SEQ ID NO: 773 - RNA, 19 nt, Homo sapiens
auauaagcuuauucgguca

SEQ ID NO: 774 - RNA, 19 nt, Homo sapiens
uauaagcuuauucggucag

SEQ ID NO: 775 - RNA, 19 nt, Homo sapiens
auaagcuuauucggucagu

SEQ ID NO: 776 - RNA, 19 nt, Homo sapiens
uaagcuuauucggucagug

SEQ ID NO: 777 - RNA, 19 nt, Homo sapiens
aagcuuauucggucagugu

SEQ ID NO: 778 - RNA, 19 nt, Homo sapiens
agcuuauucggucaguguu

SEQ ID NO: 779 - RNA, 19 nt, Homo sapiens
gcuuauucggucaguguug

SEQ ID NO: 780 - RNA, 19 nt, Homo sapiens
cuuauucggucaguguuga

SEQ ID NO: 781 - RNA, 19 nt, Homo sapiens
uuauucggucaguguugaa

SEQ ID NO: 782 - RNA, 19 nt, Homo sapiens
uauucggucaguguugaau

SEQ ID NO: 783 - RNA, 19 nt, Homo sapiens
auucggucaguguugaauu

SEQ ID NO: 784 - RNA, 19 nt, Homo sapiens
uucggucaguguugaauug

SEQ ID NO: 785 - RNA, 19 nt, Homo sapiens
ucggucaguguugaauugu

SEQ ID NO: 786 - RNA, 19 nt, Homo sapiens
cggucaguguugaauugua

SEQ ID NO: 787 - RNA, 19 nt, Homo sapiens
ggucaguguugaauuguac

SEQ ID NO: 788 - RNA, 19 nt, Homo sapiens
gucaguguugaauuguacc

SEQ ID NO: 789 - RNA, 19 nt, Homo sapiens
ucaguguugaauuguacca

SEQ ID NO: 790 - RNA, 19 nt, Homo sapiens
caguguugaauuguaccau

SEQ ID NO: 791 - RNA, 19 nt, Homo sapiens
aguguugaauuguaccauu

SEQ ID NO: 792 - RNA, 19 nt, Homo sapiens
guguugaauuguaccauuu

SEQ ID NO: 793 - RNA, 19 nt, Homo sapiens
uguugaauuguaccauuuc

SEQ ID NO: 794 - RNA, 19 nt, Homo sapiens
guugaauuguaccauuuca

SEQ ID NO: 795 - RNA, 19 nt, Homo sapiens
uugaauuguaccauuucau

SEQ ID NO: 796 - RNA, 19 nt, Homo sapiens
ugaauuguaccauuucauu

SEQ ID NO: 797 - RNA, 19 nt, Homo sapiens
gaauuguaccauuucauua

SEQ ID NO: 798 - RNA, 19 nt, Homo sapiens
aauuguaccauuucauuau

SEQ ID NO: 799 - RNA, 19 nt, Homo sapiens
auuguaccauuucauuauu

SEQ ID NO: 800 - RNA, 19 nt, Homo sapiens
uuguaccauuucauuauuu

SEQ ID NO: 801 - RNA, 19 nt, Homo sapiens
uguaccauuucauuauuuc

SEQ ID NO: 802 - RNA, 19 nt, Homo sapiens
guaccauuucauuauuucu

SEQ ID NO: 803 - RNA, 19 nt, Homo sapiens
uaccauuucauuauuucuu

SEQ ID NO: 804 - RNA, 19 nt, Homo sapiens
accauuucauuauuucuuu

SEQ ID NO: 805 - RNA, 19 nt, Homo sapiens
ccauuucauuauuucuuuu

SEQ ID NO: 806 - RNA, 19 nt, Homo sapiens
cauuucauuauuucuuuuc

SEQ ID NO: 807 - RNA, 19 nt, Homo sapiens
auuucauuauuucuuuucc

SEQ ID NO: 808 - RNA, 19 nt, Homo sapiens
uuucauuauuucuuuucca

SEQ ID NO: 809 - RNA, 19 nt, Homo sapiens
uucauuauuucuuuuccag

SEQ ID NO: 810 - RNA, 19 nt, Homo sapiens
ucauuauuucuuuuccaga

SEQ ID NO: 811 - RNA, 19 nt, Homo sapiens
cauuauuucuuuuccagaa

SEQ ID NO: 812 - RNA, 19 nt, Homo sapiens
auuauuucuuuuccagaaa

SEQ ID NO: 813 - RNA, 19 nt, Homo sapiens
uuauuucuuuuccagaaaa

SEQ ID NO: 814 - RNA, 19 nt, Homo sapiens
uauuucuuuuccagaaaag

SEQ ID NO: 815 - RNA, 19 nt, Homo sapiens
auuucuuuuccagaaaagc

SEQ ID NO: 816 - RNA, 19 nt, Homo sapiens
uuucuuuuccagaaaagcu

SEQ ID NO: 817 - RNA, 19 nt, Homo sapiens
uucuuuuccagaaaagcuu

SEQ ID NO: 818 - RNA, 19 nt, Homo sapiens
ucuuuuccagaaaagcuuu

SEQ ID NO: 819 - RNA, 19 nt, Homo sapiens
cuuuuccagaaaagcuuug

SEQ ID NO: 820 - RNA, 19 nt, Homo sapiens
uuuuccagaaaagcuuugg

SEQ ID NO: 821 - RNA, 19 nt, Homo sapiens
uuuccagaaaagcuuuggu

SEQ ID NO: 822 - RNA, 19 nt, Homo sapiens
uuccagaaaagcuuuggug

SEQ ID NO: 823 - RNA, 19 nt, Homo sapiens
uccagaaaagcuuuggugg

SEQ ID NO: 824 - RNA, 19 nt, Homo sapiens
ccagaaaagcuuuggugga

SEQ ID NO: 825 - RNA, 19 nt, Homo sapiens
cagaaaagcuuugguggag

SEQ ID NO: 826 - RNA, 19 nt, Homo sapiens
agaaaagcuuugguggagg

SEQ ID NO: 827 - RNA, 19 nt, Homo sapiens
gaaaagcuuugguggaggu

SEQ ID NO: 828 - RNA, 19 nt, Homo sapiens
aaaagcuuugguggaggua

SEQ ID NO: 829 - RNA, 19 nt, Homo sapiens
aaagcuuugguggagguau

SEQ ID NO: 830 - RNA, 19 nt, Homo sapiens
aagcuuugguggagguaua

SEQ ID NO: 831 - RNA, 19 nt, Homo sapiens
agcuuugguggagguauag

SEQ ID NO: 832 - RNA, 19 nt, Homo sapiens
gcuuugguggagguauagc

SEQ ID NO: 833 - RNA, 19 nt, Homo sapiens
cuuugguggagguauagcc

SEQ ID NO: 834 - RNA, 19 nt, Homo sapiens
uuugguggagguauagccg

SEQ ID NO: 835 - RNA, 19 nt, Homo sapiens
uugguggagguauagccga

SEQ ID NO: 836 - RNA, 19 nt, Homo sapiens
ugguggagguauagccgag

SEQ ID NO: 837 - RNA, 19 nt, Homo sapiens
gguggagguauagccgaga

SEQ ID NO: 838 - RNA, 19 nt, Homo sapiens
guggagguauagccgagau

SEQ ID NO: 839 - RNA, 19 nt, Homo sapiens
uggagguauagccgagauc

SEQ ID NO: 840 - RNA, 19 nt, Homo sapiens
ggagguauagccgagaucu

SEQ ID NO: 841 - RNA, 19 nt, Homo sapiens
gagguauagccgagaucug

SEQ ID NO: 842 - RNA, 19 nt, Homo sapiens
agguauagccgagaucugg

SEQ ID NO: 843 - RNA, 19 nt, Homo sapiens
gguauagccgagaucuggc

SEQ ID NO: 844 - RNA, 19 nt, Homo sapiens
guauagccgagaucuggca

SEQ ID NO: 845 - RNA, 19 nt, Homo sapiens
uauagccgagaucuggcau

SEQ ID NO: 846 - RNA, 19 nt, Homo sapiens
auagccgagaucuggcauu

SEQ ID NO: 847 - RNA, 19 nt, Homo sapiens
uagccgagaucuggcauuc

SEQ ID NO: 848 - RNA, 19 nt, Homo sapiens
agccgagaucuggcauucu

SEQ ID NO: 849 - RNA, 19 nt, Homo sapiens
gccgagaucuggcauucua

SEQ ID NO: 850 - RNA, 19 nt, Homo sapiens
ccgagaucuggcauucuag

SEQ ID NO: 851 - RNA, 19 nt, Homo sapiens
cgagaucuggcauucuagu

SEQ ID NO: 852 - RNA, 19 nt, Homo sapiens
gagaucuggcauucuaguu

SEQ ID NO: 853 - RNA, 19 nt, Homo sapiens
agaucuggcauucuaguuu

SEQ ID NO: 854 - RNA, 19 nt, Homo sapiens
gaucuggcauucuaguuuc

SEQ ID NO: 855 - RNA, 19 nt, Homo sapiens
aucuggcauucuaguuuca

SEQ ID NO: 856 - RNA, 19 nt, Homo sapiens
ucuggcauucuaguuucac

SEQ ID NO: 857 - RNA, 19 nt, Homo sapiens
cuggcauucuaguuucacu

SEQ ID NO: 858 - RNA, 19 nt, Homo sapiens
uggcauucuaguuucacug

SEQ ID NO: 859 - RNA, 19 nt, Homo sapiens
ggcauucuaguuucacuga

SEQ ID NO: 860 - RNA, 19 nt, Homo sapiens
gcauucuaguuucacugaa

SEQ ID NO: 861 - RNA, 19 nt, Homo sapiens
cauucuaguuucacugaau

SEQ ID NO: 862 - RNA, 19 nt, Homo sapiens
auucuaguuucacugaauc

SEQ ID NO: 863 - RNA, 19 nt, Homo sapiens
uucuaguuucacugaaucu

SEQ ID NO: 864 - RNA, 19 nt, Homo sapiens
ucuaguuucacugaaucuc

SEQ ID NO: 865 - RNA, 19 nt, Homo sapiens
cuaguuucacugaaucucc

SEQ ID NO: 866 - RNA, 19 nt, Homo sapiens
uaguuucacugaaucuccc

SEQ ID NO: 867 - RNA, 19 nt, Homo sapiens
aguuucacugaaucucccu

SEQ ID NO: 868 - RNA, 19 nt, Homo sapiens
guuucacugaaucucccuc

SEQ ID NO: 869 - RNA, 19 nt, Homo sapiens
uuucacugaaucucccucu

SEQ ID NO: 870 - RNA, 19 nt, Homo sapiens
uucacugaaucucccucua

SEQ ID NO: 871 - RNA, 19 nt, Homo sapiens
ucacugaaucucccucuaa

SEQ ID NO: 872 - RNA, 19 nt, Homo sapiens
cacugaaucucccucuaaa

SEQ ID NO: 873 - RNA, 19 nt, Homo sapiens
acugaaucucccucuaaaa

SEQ ID NO: 874 - RNA, 19 nt, Homo sapiens
cugaaucucccucuaaaac

SEQ ID NO: 875 - RNA, 19 nt, Homo sapiens
ugaaucucccucuaaaacu

SEQ ID NO: 876 - RNA, 19 nt, Homo sapiens
gaaucucccucuaaaacuu

SEQ ID NO: 877 - RNA, 19 nt, Homo sapiens
aaucucccucuaaaacuuu

SEQ ID NO: 878 - RNA, 19 nt, Homo sapiens
aucucccucuaaaacuuuu

SEQ ID NO: 879 - RNA, 19 nt, Homo sapiens
ucucccucuaaaacuuuuu

SEQ ID NO: 880 - RNA, 19 nt, Homo sapiens
cucccucuaaaacuuuuuu

SEQ ID NO: 881 - RNA, 19 nt, Homo sapiens
ucccucuaaaacuuuuuug

SEQ ID NO: 882 - RNA, 19 nt, Homo sapiens
cccucuaaaacuuuuuugc

SEQ ID NO: 883 - RNA, 19 nt, Homo sapiens
ccucuaaaacuuuuuugcu

SEQ ID NO: 884 - RNA, 19 nt, Homo sapiens
cucuaaaacuuuuuugcuc

SEQ ID NO: 885 - RNA, 19 nt, Homo sapiens
ucuaaaacuuuuuugcucu

SEQ ID NO: 886 - RNA, 19 nt, Homo sapiens
cuaaaacuuuuuugcucug

SEQ ID NO: 887 - RNA, 19 nt, Homo sapiens
uaaaacuuuuuugcucugu

SEQ ID NO: 888 - RNA, 19 nt, Homo sapiens
aaaacuuuuuugcucugug

SEQ ID NO: 889 - RNA, 19 nt, Homo sapiens
aaacuuuuuugcucugugg

SEQ ID NO: 890 - RNA, 19 nt, Homo sapiens
aacuuuuuugcucuguggu

SEQ ID NO: 891 - RNA, 19 nt, Homo sapiens
acuuuuuugcucugugguu

SEQ ID NO: 892 - RNA, 19 nt, Homo sapiens
cuuuuuugcucugugguuu

SEQ ID NO: 893 - RNA, 19 nt, Homo sapiens
uuuuuugcucugugguuug

SEQ ID NO: 894 - RNA, 19 nt, Homo sapiens
uuuuugcucugugguuugu

SEQ ID NO: 895 - RNA, 19 nt, Homo sapiens
uuuugcucugugguuugua

SEQ ID NO: 896 - RNA, 19 nt, Homo sapiens
uuugcucugugguuuguag

SEQ ID NO: 897 - RNA, 19 nt, Homo sapiens
uugcucugugguuuguaga

SEQ ID NO: 898 - RNA, 19 nt, Homo sapiens
ugcucugugguuuguagau

SEQ ID NO: 899 - RNA, 19 nt, Homo sapiens
gcucugugguuuguagaua

SEQ ID NO: 900 - RNA, 19 nt, Homo sapiens
cucugugguuuguagauaa

SEQ ID NO: 901 - RNA, 19 nt, Homo sapiens
ucugugguuuguagauaaa

SEQ ID NO: 902 - RNA, 19 nt, Homo sapiens
cugugguuuguagauaaac

SEQ ID NO: 903 - RNA, 19 nt, Homo sapiens
ugugguuuguagauaaaca

SEQ ID NO: 904 - RNA, 19 nt, Homo sapiens
gugguuuguagauaaacau

SEQ ID NO: 905 - RNA, 19 nt, Homo sapiens
ugguuuguagauaaacauu

SEQ ID NO: 906 - RNA, 19 nt, Homo sapiens
gguuuguagauaaacauug

SEQ ID NO: 907 - RNA, 19 nt, Homo sapiens
guuuguagauaaacauugg

SEQ ID NO: 908 - RNA, 19 nt, Homo sapiens
uuuguagauaaacauuggu

SEQ ID NO: 909 - RNA, 19 nt, Homo sapiens
uuguagauaaacauuggug

SEQ ID NO: 910 - RNA, 19 nt, Homo sapiens
uguagauaaacauuggugc

SEQ ID NO: 911 - RNA, 19 nt, Homo sapiens
guagauaaacauuggugcu

SEQ ID NO: 912 - RNA, 19 nt, Homo sapiens
uagauaaacauuggugcuc

SEQ ID NO: 913 - RNA, 19 nt, Homo sapiens
agauaaacauuggugcucu

SEQ ID NO: 914 - RNA, 19 nt, Homo sapiens
gauaaacauuggugcucuu

SEQ ID NO: 915 - RNA, 19 nt, Homo sapiens
auaaacauuggugcucuuu

SEQ ID NO: 916 - RNA, 19 nt, Homo sapiens
uaaacauuggugcucuuuu

SEQ ID NO: 917 - RNA, 19 nt, Homo sapiens
aaacauuggugcucuuuua

SEQ ID NO: 918 - RNA, 19 nt, Homo sapiens
aacauuggugcucuuuuau

SEQ ID NO: 919 - RNA, 19 nt, Homo sapiens
acauuggugcucuuuuaug

SEQ ID NO: 920 - RNA, 19 nt, Homo sapiens
cauuggugcucuuuuaugu

SEQ ID NO: 921 - RNA, 19 nt, Homo sapiens
auuggugcucuuuuauguu

SEQ ID NO: 922 - RNA, 19 nt, Homo sapiens
uuggugcucuuuuauguuc

SEQ ID NO: 923 - RNA, 19 nt, Homo sapiens
uggugcucuuuuauguucu

SEQ ID NO: 924 - RNA, 19 nt, Homo sapiens
ggugcucuuuuauguucuu

SEQ ID NO: 925 - RNA, 19 nt, Homo sapiens
gugcucuuuuauguucuuu

SEQ ID NO: 926 - RNA, 19 nt, Homo sapiens
ugcucuuuuauguucuuuu

SEQ ID NO: 927 - RNA, 19 nt, Homo sapiens
gcucuuuuauguucuuuug

SEQ ID NO: 928 - RNA, 19 nt, Homo sapiens
cucuuuuauguucuuuugc

SEQ ID NO: 929 - RNA, 19 nt, Homo sapiens
ucuuuuauguucuuuugca

SEQ ID NO: 930 - RNA, 19 nt, Homo sapiens
cuuuuauguucuuuugcaa

SEQ ID NO: 931 - RNA, 19 nt, Homo sapiens
uuuuauguucuuuugcaag

SEQ ID NO: 932 - RNA, 19 nt, Homo sapiens
uuuauguucuuuugcaagg

SEQ ID NO: 933 - RNA, 19 nt, Homo sapiens
uuauguucuuuugcaagga

SEQ ID NO: 934 - RNA, 19 nt, Homo sapiens
uauguucuuuugcaaggac

SEQ ID NO: 935 - RNA, 19 nt, Homo sapiens
auguucuuuugcaaggaca

SEQ ID NO: 936 - RNA, 19 nt, Homo sapiens
uguucuuuugcaaggacau

SEQ ID NO: 937 - RNA, 19 nt, Homo sapiens
guucuuuugcaaggacauc

SEQ ID NO: 938 - RNA, 19 nt, Homo sapiens
uucuuuugcaaggacaucc

SEQ ID NO: 939 - RNA, 19 nt, Homo sapiens
ucuuuugcaaggacaucca

SEQ ID NO: 940 - RNA, 19 nt, Homo sapiens
cuuuugcaaggacauccag

SEQ ID NO: 941 - RNA, 19 nt, Homo sapiens
uuuugcaaggacauccagc

SEQ ID NO: 942 - RNA, 19 nt, Homo sapiens
uuugcaaggacauccagcu

SEQ ID NO: 943 - RNA, 19 nt, Homo sapiens
uugcaaggacauccagcug

SEQ ID NO: 944 - RNA, 19 nt, Homo sapiens
ugcaaggacauccagcugc

SEQ ID NO: 945 - RNA, 19 nt, Homo sapiens
gcaaggacauccagcugca

SEQ ID NO: 946 - RNA, 19 nt, Homo sapiens
caaggacauccagcugcac

SEQ ID NO: 947 - RNA, 19 nt, Homo sapiens
aaggacauccagcugcaca

SEQ ID NO: 948 - RNA, 19 nt, Homo sapiens
aggacauccagcugcacag

SEQ ID NO: 949 - RNA, 19 nt, Homo sapiens
ggacauccagcugcacagu

SEQ ID NO: 950 - RNA, 19 nt, Homo sapiens
gacauccagcugcacagug

SEQ ID NO: 951 - RNA, 19 nt, Homo sapiens
acauccagcugcacaguga

SEQ ID NO: 952 - RNA, 19 nt, Homo sapiens
cauccagcugcacagugaa

SEQ ID NO: 953 - RNA, 19 nt, Homo sapiens
auccagcugcacagugaag

SEQ ID NO: 954 - RNA, 19 nt, Homo sapiens
uccagcugcacagugaagg

SEQ ID NO: 955 - RNA, 19 nt, Homo sapiens
ccagcugcacagugaaggu

SEQ ID NO: 956 - RNA, 19 nt, Homo sapiens
cagcugcacagugaaggug

SEQ ID NO: 957 - RNA, 19 nt, Homo sapiens
agcugcacagugaaggugg

SEQ ID NO: 958 - RNA, 19 nt, Homo sapiens
gcugcacagugaagguggc

SEQ ID NO: 959 - RNA, 19 nt, Homo sapiens
cugcacagugaagguggcu

SEQ ID NO: 960 - RNA, 19 nt, Homo sapiens
ugcacagugaagguggcuu

SEQ ID NO: 961 - RNA, 19 nt, Homo sapiens
gcacagugaagguggcuuc

SEQ ID NO: 962 - RNA, 19 nt, Homo sapiens
cacagugaagguggcuucu

SEQ ID NO: 963 - RNA, 19 nt, Homo sapiens
acagugaagguggcuucuc

SEQ ID NO: 964 - RNA, 19 nt, Homo sapiens
cagugaagguggcuucucc

SEQ ID NO: 965 - RNA, 19 nt, Homo sapiens
agugaagguggcuucuccu

SEQ ID NO: 966 - RNA, 19 nt, Homo sapiens
gugaagguggcuucuccug

SEQ ID NO: 967 - RNA, 19 nt, Homo sapiens
ugaagguggcuucuccugc

SEQ ID NO: 968 - RNA, 19 nt, Homo sapiens
gaagguggcuucuccugcu

SEQ ID NO: 969 - RNA, 19 nt, Homo sapiens
aagguggcuucuccugcuc

SEQ ID NO: 970 - RNA, 19 nt, Homo sapiens
agguggcuucuccugcucu

SEQ ID NO: 971 - RNA, 19 nt, Homo sapiens
gguggcuucuccugcucua

SEQ ID NO: 972 - RNA, 19 nt, Homo sapiens
guggcuucuccugcucuau

SEQ ID NO: 973 - RNA, 19 nt, Homo sapiens
uggcuucuccugcucuauu

SEQ ID NO: 974 - RNA, 19 nt, Homo sapiens
ggcuucuccugcucuauuc

SEQ ID NO: 975 - RNA, 19 nt, Homo sapiens
gcuucuccugcucuauucu

SEQ ID NO: 976 - RNA, 19 nt, Homo sapiens
cuucuccugcucuauucuu

SEQ ID NO: 977 - RNA, 19 nt, Homo sapiens
uucuccugcucuauucuug

SEQ ID NO: 978 - RNA, 19 nt, Homo sapiens
ucuccugcucuauucuugg

SEQ ID NO: 979 - RNA, 19 nt, Homo sapiens
cuccugcucuauucuuggc

SEQ ID NO: 980 - RNA, 19 nt, Homo sapiens
uccugcucuauucuuggca

SEQ ID NO: 981 - RNA, 19 nt, Homo sapiens
ccugcucuauucuuggcaa

SEQ ID NO: 982 - RNA, 19 nt, Homo sapiens
cugcucuauucuuggcaac

SEQ ID NO: 983 - RNA, 19 nt, Homo sapiens
ugcucuauucuuggcaaca

SEQ ID NO: 984 - RNA, 19 nt, Homo sapiens
gcucuauucuuggcaacac

SEQ ID NO: 985 - RNA, 19 nt, Homo sapiens
cucuauucuuggcaacaca

SEQ ID NO: 986 - RNA, 19 nt, Homo sapiens
ucuauucuuggcaacacau

SEQ ID NO: 987 - RNA, 19 nt, Homo sapiens
cuauucuuggcaacacaug

SEQ ID NO: 988 - RNA, 19 nt, Homo sapiens
uauucuuggcaacacaugc

SEQ ID NO: 989 - RNA, 19 nt, Homo sapiens
auucuuggcaacacaugca

SEQ ID NO: 990 - RNA, 19 nt, Homo sapiens
uucuuggcaacacaugcau

SEQ ID NO: 991 - RNA, 19 nt, Homo sapiens
ucuuggcaacacaugcaua

SEQ ID NO: 992 - RNA, 19 nt, Homo sapiens
cuuggcaacacaugcauaa

SEQ ID NO: 993 - RNA, 19 nt, Homo sapiens
uuggcaacacaugcauaag

SEQ ID NO: 994 - RNA, 19 nt, Homo sapiens
uggcaacacaugcauaagc

SEQ ID NO: 995 - RNA, 19 nt, Homo sapiens
ggcaacacaugcauaagcc

SEQ ID NO: 996 - RNA, 19 nt, Homo sapiens
gcaacacaugcauaagccc

SEQ ID NO: 997 - RNA, 19 nt, Homo sapiens
caacacaugcauaagcccc

SEQ ID NO: 998 - RNA, 19 nt, Homo sapiens
aacacaugcauaagccccu

SEQ ID NO: 999 - RNA, 19 nt, Homo sapiens
acacaugcauaagccccug

SEQ ID NO: 1000 - RNA, 19 nt, Homo sapiens
cacaugcauaagccccugc

SEQ ID NO: 1001 - RNA, 19 nt, Homo sapiens
acaugcauaagccccugca

SEQ ID NO: 1002 - RNA, 19 nt, Homo sapiens
caugcauaagccccugcau

SEQ ID NO: 1003 - RNA, 19 nt, Homo sapiens
augcauaagccccugcauc

SEQ ID NO: 1004 - RNA, 19 nt, Homo sapiens
ugcauaagccccugcaucu

SEQ ID NO: 1005 - RNA, 19 nt, Homo sapiens
gcauaagccccugcaucug

SEQ ID NO: 1006 - RNA, 19 nt, Homo sapiens
cauaagccccugcaucuga

SEQ ID NO: 1007 - RNA, 19 nt, Homo sapiens
auaagccccugcaucugaa

SEQ ID NO: 1008 - RNA, 19 nt, Homo sapiens
uaagccccugcaucugaag

SEQ ID NO: 1009 - RNA, 19 nt, Homo sapiens
aagccccugcaucugaagc

SEQ ID NO: 1010 - RNA, 19 nt, Homo sapiens
agccccugcaucugaagcu

SEQ ID NO: 1011 - RNA, 19 nt, Homo sapiens
gccccugcaucugaagcuc

SEQ ID NO: 1012 - RNA, 19 nt, Homo sapiens
ccccugcaucugaagcucu

SEQ ID NO: 1013 - RNA, 19 nt, Homo sapiens
cccugcaucugaagcucug

SEQ ID NO: 1014 - RNA, 19 nt, Homo sapiens
ccugcaucugaagcucuga

SEQ ID NO: 1015 - RNA, 19 nt, Homo sapiens
cugcaucugaagcucugac

SEQ ID NO: 1016 - RNA, 19 nt, Homo sapiens
ugcaucugaagcucugacu

SEQ ID NO: 1017 - RNA, 19 nt, Homo sapiens
gcaucugaagcucugacua

SEQ ID NO: 1018 - RNA, 19 nt, Homo sapiens
caucugaagcucugacuac

SEQ ID NO: 1019 - RNA, 19 nt, Homo sapiens
aucugaagcucugacuacu

SEQ ID NO: 1020 - RNA, 19 nt, Homo sapiens
ucugaagcucugacuacuu

SEQ ID NO: 1021 - RNA, 19 nt, Homo sapiens
cugaagcucugacuacuuc

SEQ ID NO: 1022 - RNA, 19 nt, Homo sapiens
ugaagcucugacuacuuca

SEQ ID NO: 1023 - RNA, 19 nt, Homo sapiens
gaagcucugacuacuucaa

SEQ ID NO: 1024 - RNA, 19 nt, Homo sapiens
aagcucugacuacuucaaa

SEQ ID NO: 1025 - RNA, 19 nt, Homo sapiens
agcucugacuacuucaaag

SEQ ID NO: 1026 - RNA, 19 nt, Homo sapiens
gcucugacuacuucaaaga

SEQ ID NO: 1027 - RNA, 19 nt, Homo sapiens
cucugacuacuucaaagau

SEQ ID NO: 1028 - RNA, 19 nt, Homo sapiens
ucugacuacuucaaagaug

SEQ ID NO: 1029 - RNA, 19 nt, Homo sapiens
cugacuacuucaaagauga

SEQ ID NO: 1030 - RNA, 19 nt, Homo sapiens
ugacuacuucaaagaugag

SEQ ID NO: 1031 - RNA, 19 nt, Homo sapiens
gacuacuucaaagaugagu

SEQ ID NO: 1032 - RNA, 19 nt, Homo sapiens
acuacuucaaagaugagug

SEQ ID NO: 1033 - RNA, 19 nt, Homo sapiens
cuacuucaaagaugaguga

SEQ ID NO: 1034 - RNA, 19 nt, Homo sapiens
uacuucaaagaugagugaa

SEQ ID NO: 1035 - RNA, 19 nt, Homo sapiens
acuucaaagaugagugaau

SEQ ID NO: 1036 - RNA, 19 nt, Homo sapiens
cuucaaagaugagugaaug

SEQ ID NO: 1037 - RNA, 19 nt, Homo sapiens
uucaaagaugagugaauga

SEQ ID NO: 1038 - RNA, 19 nt, Homo sapiens
ucaaagaugagugaaugaa

SEQ ID NO: 1039 - RNA, 19 nt, Homo sapiens
caaagaugagugaaugaag

SEQ ID NO: 1040 - RNA, 19 nt, Homo sapiens
aaagaugagugaaugaaga

SEQ ID NO: 1041 - RNA, 19 nt, Homo sapiens
aagaugagugaaugaagac

SEQ ID NO: 1042 - RNA, 19 nt, Homo sapiens
agaugagugaaugaagacc

SEQ ID NO: 1043 - RNA, 19 nt, Homo sapiens
gaugagugaaugaagaccc

SEQ ID NO: 1044 - RNA, 19 nt, Homo sapiens
augagugaaugaagacccu

SEQ ID NO: 1045 - RNA, 19 nt, Homo sapiens
ugagugaaugaagacccuu

SEQ ID NO: 1046 - RNA, 19 nt, Homo sapiens
gagugaaugaagacccuuc

SEQ ID NO: 1047 - RNA, 19 nt, Homo sapiens
agugaaugaagacccuucu

SEQ ID NO: 1048 - RNA, 19 nt, Homo sapiens
gugaaugaagacccuucuc

SEQ ID NO: 1049 - RNA, 19 nt, Homo sapiens
ugaaugaagacccuucuca

SEQ ID NO: 1050 - RNA, 19 nt, Homo sapiens
gaaugaagacccuucucag

SEQ ID NO: 1051 - RNA, 19 nt, Homo sapiens
aaugaagacccuucucaga

SEQ ID NO: 1052 - RNA, 19 nt, Homo sapiens
augaagacccuucucagac

SEQ ID NO: 1053 - RNA, 19 nt, Homo sapiens
ugaagacccuucucagaca

SEQ ID NO: 1054 - RNA, 19 nt, Homo sapiens
gaagacccuucucagacac

SEQ ID NO: 1055 - RNA, 19 nt, Homo sapiens
aagacccuucucagacacu

SEQ ID NO: 1056 - RNA, 19 nt, Homo sapiens
agacccuucucagacacua

SEQ ID NO: 1057 - RNA, 19 nt, Homo sapiens
gacccuucucagacacuau

SEQ ID NO: 1058 - RNA, 19 nt, Homo sapiens
acccuucucagacacuauc

SEQ ID NO: 1059 - RNA, 19 nt, Homo sapiens
cccuucucagacacuauca

SEQ ID NO: 1060 - RNA, 19 nt, Homo sapiens
ccuucucagacacuaucau

SEQ ID NO: 1061 - RNA, 19 nt, Homo sapiens
cuucucagacacuaucauu

SEQ ID NO: 1062 - RNA, 19 nt, Homo sapiens
uucucagacacuaucauuu

SEQ ID NO: 1063 - RNA, 19 nt, Homo sapiens
ucucagacacuaucauuuu

SEQ ID NO: 1064 - RNA, 19 nt, Homo sapiens
cucagacacuaucauuuug

SEQ ID NO: 1065 - RNA, 19 nt, Homo sapiens
ucagacacuaucauuuugu

SEQ ID NO: 1066 - RNA, 19 nt, Homo sapiens
cagacacuaucauuuugug

SEQ ID NO: 1067 - RNA, 19 nt, Homo sapiens
agacacuaucauuuugugc

SEQ ID NO: 1068 - RNA, 19 nt, Homo sapiens
gacacuaucauuuugugca

SEQ ID NO: 1069 - RNA, 19 nt, Homo sapiens
acacuaucauuuugugcaa

SEQ ID NO: 1070 - RNA, 19 nt, Homo sapiens
cacuaucauuuugugcaaa

SEQ ID NO: 1071 - RNA, 19 nt, Homo sapiens
acuaucauuuugugcaaau

SEQ ID NO: 1072 - RNA, 19 nt, Homo sapiens
cuaucauuuugugcaaauc

SEQ ID NO: 1073 - RNA, 19 nt, Homo sapiens
uaucauuuugugcaaauca

SEQ ID NO: 1074 - RNA, 19 nt, Homo sapiens
aucauuuugugcaaaucau

SEQ ID NO: 1075 - RNA, 19 nt, Homo sapiens
ucauuuugugcaaaucauc

SEQ ID NO: 1076 - RNA, 19 nt, Homo sapiens
cauuuugugcaaaucaucu

SEQ ID NO: 1077 - RNA, 19 nt, Homo sapiens
auuuugugcaaaucaucug

SEQ ID NO: 1078 - RNA, 19 nt, Homo sapiens
uuuugugcaaaucaucuga

SEQ ID NO: 1079 - RNA, 19 nt, Homo sapiens
uuugugcaaaucaucugau

SEQ ID NO: 1080 - RNA, 19 nt, Homo sapiens
uugugcaaaucaucugauu

SEQ ID NO: 1081 - RNA, 19 nt, Homo sapiens
ugugcaaaucaucugauug

SEQ ID NO: 1082 - RNA, 19 nt, Homo sapiens
gugcaaaucaucugauuga

SEQ ID NO: 1083 - RNA, 19 nt, Homo sapiens
ugcaaaucaucugauugaa

SEQ ID NO: 1084 - RNA, 19 nt, Homo sapiens
gcaaaucaucugauugaac

SEQ ID NO: 1085 - RNA, 19 nt, Homo sapiens
caaaucaucugauugaacu

SEQ ID NO: 1086 - RNA, 19 nt, Homo sapiens
aaaucaucugauugaacug

SEQ ID NO: 1087 - RNA, 19 nt, Homo sapiens
aaucaucugauugaacugu

SEQ ID NO: 1088 - RNA, 19 nt, Homo sapiens
aucaucugauugaacuguu

SEQ ID NO: 1089 - RNA, 19 nt, Homo sapiens
ucaucugauugaacuguuc

SEQ ID NO: 1090 - RNA, 19 nt, Homo sapiens
caucugauugaacuguucu

SEQ ID NO: 1091 - RNA, 19 nt, Homo sapiens
aucugauugaacuguucuu

SEQ ID NO: 1092 - RNA, 19 nt, Homo sapiens
ucugauugaacuguucuuc

SEQ ID NO: 1093 - RNA, 19 nt, Homo sapiens
cugauugaacuguucuucc

SEQ ID NO: 1094 - RNA, 19 nt, Homo sapiens
ugauugaacuguucuucca

SEQ ID NO: 1095 - RNA, 19 nt, Homo sapiens
gauugaacuguucuuccau

SEQ ID NO: 1096 - RNA, 19 nt, Homo sapiens
auugaacuguucuuccauu

SEQ ID NO: 1097 - RNA, 19 nt, Homo sapiens
uugaacuguucuuccauuu

SEQ ID NO: 1098 - RNA, 19 nt, Homo sapiens
ugaacuguucuuccauuua

SEQ ID NO: 1099 - RNA, 19 nt, Homo sapiens
gaacuguucuuccauuuag

SEQ ID NO: 1100 - RNA, 19 nt, Homo sapiens
aacuguucuuccauuuaga

SEQ ID NO: 1101 - RNA, 19 nt, Homo sapiens
acuguucuuccauuuagau

SEQ ID NO: 1102 - RNA, 19 nt, Homo sapiens
cuguucuuccauuuagaua

SEQ ID NO: 1103 - RNA, 19 nt, Homo sapiens
uguucuuccauuuagauac

SEQ ID NO: 1104 - RNA, 19 nt, Homo sapiens
guucuuccauuuagauacc

SEQ ID NO: 1105 - RNA, 19 nt, Homo sapiens
uucuuccauuuagauacca

SEQ ID NO: 1106 - RNA, 19 nt, Homo sapiens
ucuuccauuuagauaccau

SEQ ID NO: 1107 - RNA, 19 nt, Homo sapiens
cuuccauuuagauaccaug

SEQ ID NO: 1108 - RNA, 19 nt, Homo sapiens
uuccauuuagauaccauga

SEQ ID NO: 1109 - RNA, 19 nt, Homo sapiens
uccauuuagauaccaugac

SEQ ID NO: 1110 - RNA, 19 nt, Homo sapiens
ccauuuagauaccaugaca

SEQ ID NO: 1111 - RNA, 19 nt, Homo sapiens
cauuuagauaccaugacac

SEQ ID NO: 1112 - RNA, 19 nt, Homo sapiens
auuuagauaccaugacaca

SEQ ID NO: 1113 - RNA, 19 nt, Homo sapiens
uuuagauaccaugacacau

SEQ ID NO: 1114 - RNA, 19 nt, Homo sapiens
uuagauaccaugacacauc

SEQ ID NO: 1115 - RNA, 19 nt, Homo sapiens
uagauaccaugacacauca

SEQ ID NO: 1116 - RNA, 19 nt, Homo sapiens
agauaccaugacacaucag

SEQ ID NO: 1117 - RNA, 19 nt, Homo sapiens
gauaccaugacacaucagg

SEQ ID NO: 1118 - RNA, 19 nt, Homo sapiens
auaccaugacacaucagga

SEQ ID NO: 1119 - RNA, 19 nt, Homo sapiens
uaccaugacacaucaggag

SEQ ID NO: 1120 - RNA, 19 nt, Homo sapiens
accaugacacaucaggagc

SEQ ID NO: 1121 - RNA, 19 nt, Homo sapiens
ccaugacacaucaggagcu

SEQ ID NO: 1122 - RNA, 19 nt, Homo sapiens
caugacacaucaggagcug

SEQ ID NO: 1123 - RNA, 19 nt, Homo sapiens
augacacaucaggagcugg

SEQ ID NO: 1124 - RNA, 19 nt, Homo sapiens
ugacacaucaggagcuggc

SEQ ID NO: 1125 - RNA, 19 nt, Homo sapiens
gacacaucaggagcuggca

SEQ ID NO: 1126 - RNA, 19 nt, Homo sapiens
acacaucaggagcuggcag

SEQ ID NO: 1127 - RNA, 19 nt, Homo sapiens
cacaucaggagcuggcagu

SEQ ID NO: 1128 - RNA, 19 nt, Homo sapiens
acaucaggagcuggcaguc

SEQ ID NO: 1129 - RNA, 19 nt, Homo sapiens
caucaggagcuggcagucc

SEQ ID NO: 1130 - RNA, 19 nt, Homo sapiens
aucaggagcuggcagucca

SEQ ID NO: 1131 - RNA, 19 nt, Homo sapiens
ucaggagcuggcaguccac

SEQ ID NO: 1132 - RNA, 19 nt, Homo sapiens
caggagcuggcaguccacu

SEQ ID NO: 1133 - RNA, 19 nt, Homo sapiens
aggagcuggcaguccacuc

SEQ ID NO: 1134 - RNA, 19 nt, Homo sapiens
ggagcuggcaguccacuca

SEQ ID NO: 1135 - RNA, 19 nt, Homo sapiens
gagcuggcaguccacucac

SEQ ID NO: 1136 - RNA, 19 nt, Homo sapiens
agcuggcaguccacucacu

SEQ ID NO: 1137 - RNA, 19 nt, Homo sapiens
gcuggcaguccacucacuu

SEQ ID NO: 1138 - RNA, 19 nt, Homo sapiens
cuggcaguccacucacuuu

SEQ ID NO: 1139 - RNA, 19 nt, Homo sapiens
uggcaguccacucacuuug

SEQ ID NO: 1140 - RNA, 19 nt, Homo sapiens
ggcaguccacucacuuuga

SEQ ID NO: 1141 - RNA, 19 nt, Homo sapiens
gcaguccacucacuuugaa

SEQ ID NO: 1142 - RNA, 19 nt, Homo sapiens
caguccacucacuuugaag

SEQ ID NO: 1143 - RNA, 19 nt, Homo sapiens
aguccacucacuuugaagu

SEQ ID NO: 1144 - RNA, 19 nt, Homo sapiens
guccacucacuuugaaguc

SEQ ID NO: 1145 - RNA, 19 nt, Homo sapiens
uccacucacuuugaagucc

SEQ ID NO: 1146 - RNA, 19 nt, Homo sapiens
ccacucacuuugaagucca

SEQ ID NO: 1147 - RNA, 19 nt, Homo sapiens
cacucacuuugaaguccau

SEQ ID NO: 1148 - RNA, 19 nt, Homo sapiens
acucacuuugaaguccauu

SEQ ID NO: 1149 - RNA, 19 nt, Homo sapiens
cucacuuugaaguccauuc

SEQ ID NO: 1150 - RNA, 19 nt, Homo sapiens
ucacuuugaaguccauucu

SEQ ID NO: 1151 - RNA, 19 nt, Homo sapiens
cacuuugaaguccauucug

SEQ ID NO: 1152 - RNA, 19 nt, Homo sapiens
acuuugaaguccauucugc

SEQ ID NO: 1153 - RNA, 19 nt, Homo sapiens
cuuugaaguccauucugca

SEQ ID NO: 1154 - RNA, 19 nt, Homo sapiens
uuugaaguccauucugcag

SEQ ID NO: 1155 - RNA, 19 nt, Homo sapiens
uugaaguccauucugcaga

SEQ ID NO: 1156 - RNA, 19 nt, Homo sapiens
ugaaguccauucugcagaa

SEQ ID NO: 1157 - RNA, 19 nt, Homo sapiens
gaaguccauucugcagaau

SEQ ID NO: 1158 - RNA, 19 nt, Homo sapiens
aaguccauucugcagaauc

SEQ ID NO: 1159 - RNA, 19 nt, Homo sapiens
aguccauucugcagaaucu

SEQ ID NO: 1160 - RNA, 19 nt, Homo sapiens
guccauucugcagaaucuu

SEQ ID NO: 1161 - RNA, 19 nt, Homo sapiens
uccauucugcagaaucuuc

SEQ ID NO: 1162 - RNA, 19 nt, Homo sapiens
ccauucugcagaaucuucc

SEQ ID NO: 1163 - RNA, 19 nt, Homo sapiens
cauucugcagaaucuuccu

SEQ ID NO: 1164 - RNA, 19 nt, Homo sapiens
auucugcagaaucuuccuu

SEQ ID NO: 1165 - RNA, 19 nt, Homo sapiens
uucugcagaaucuuccuuc

SEQ ID NO: 1166 - RNA, 19 nt, Homo sapiens
ucugcagaaucuuccuuca

SEQ ID NO: 1167 - RNA, 19 nt, Homo sapiens
cugcagaaucuuccuucau

SEQ ID NO: 1168 - RNA, 19 nt, Homo sapiens
ugcagaaucuuccuucauc

SEQ ID NO: 1169 - RNA, 19 nt, Homo sapiens
gcagaaucuuccuucauca

SEQ ID NO: 1170 - RNA, 19 nt, Homo sapiens
cagaaucuuccuucaucaa

SEQ ID NO: 1171 - RNA, 19 nt, Homo sapiens
agaaucuuccuucaucaau

SEQ ID NO: 1172 - RNA, 19 nt, Homo sapiens
gaaucuuccuucaucaauc

SEQ ID NO: 1173 - RNA, 19 nt, Homo sapiens
aaucuuccuucaucaaucg

SEQ ID NO: 1174 - RNA, 19 nt, Homo sapiens
aucuuccuucaucaaucga

SEQ ID NO: 1175 - RNA, 19 nt, Homo sapiens
ucuuccuucaucaaucgac

SEQ ID NO: 1176 - RNA, 19 nt, Homo sapiens
cuuccuucaucaaucgaca

SEQ ID NO: 1177 - RNA, 19 nt, Homo sapiens
uuccuucaucaaucgacau

SEQ ID NO: 1178 - RNA, 19 nt, Homo sapiens
uccuucaucaaucgacaug

SEQ ID NO: 1179 - RNA, 19 nt, Homo sapiens
ccuucaucaaucgacaugu

SEQ ID NO: 1180 - RNA, 19 nt, Homo sapiens
cuucaucaaucgacauguu

SEQ ID NO: 1181 - RNA, 19 nt, Homo sapiens
uucaucaaucgacauguuc

SEQ ID NO: 1182 - RNA, 19 nt, Homo sapiens
ucaucaaucgacauguucu

SEQ ID NO: 1183 - RNA, 19 nt, Homo sapiens
caucaaucgacauguucuc

SEQ ID NO: 1184 - RNA, 19 nt, Homo sapiens
aucaaucgacauguucucu

SEQ ID NO: 1185 - RNA, 19 nt, Homo sapiens
ucaaucgacauguucucug

SEQ ID NO: 1186 - RNA, 19 nt, Homo sapiens
caaucgacauguucucugg

SEQ ID NO: 1187 - RNA, 19 nt, Homo sapiens
aaucgacauguucucuggc

SEQ ID NO: 1188 - RNA, 19 nt, Homo sapiens
aucgacauguucucuggca

SEQ ID NO: 1189 - RNA, 19 nt, Homo sapiens
ucgacauguucucuggcac

SEQ ID NO: 1190 - RNA, 19 nt, Homo sapiens
cgacauguucucuggcacu

SEQ ID NO: 1191 - RNA, 19 nt, Homo sapiens
gacauguucucuggcacuu

SEQ ID NO: 1192 - RNA, 19 nt, Homo sapiens
acauguucucuggcacuug

SEQ ID NO: 1193 - RNA, 19 nt, Homo sapiens
cauguucucuggcacuuga

SEQ ID NO: 1194 - RNA, 19 nt, Homo sapiens
auguucucuggcacuugaa

SEQ ID NO: 1195 - RNA, 19 nt, Homo sapiens
uguucucuggcacuugaau

SEQ ID NO: 1196 - RNA, 19 nt, Homo sapiens
guucucuggcacuugaaug

SEQ ID NO: 1197 - RNA, 19 nt, Homo sapiens
uucucuggcacuugaauga

SEQ ID NO: 1198 - RNA, 19 nt, Homo sapiens
ucucuggcacuugaaugaa

SEQ ID NO: 1199 - RNA, 19 nt, Homo sapiens
cucuggcacuugaaugaaa

SEQ ID NO: 1200 - RNA, 19 nt, Homo sapiens
ucuggcacuugaaugaaac

SEQ ID NO: 1201 - RNA, 19 nt, Homo sapiens
cuggcacuugaaugaaacg

SEQ ID NO: 1202 - RNA, 19 nt, Homo sapiens
uggcacuugaaugaaacgu

SEQ ID NO: 1203 - RNA, 19 nt, Homo sapiens
ggcacuugaaugaaacgug

SEQ ID NO: 1204 - RNA, 19 nt, Homo sapiens
gcacuugaaugaaacgugg

SEQ ID NO: 1205 - RNA, 19 nt, Homo sapiens
cacuugaaugaaacguggu

SEQ ID NO: 1206 - RNA, 19 nt, Homo sapiens
acuugaaugaaacguggug

SEQ ID NO: 1207 - RNA, 19 nt, Homo sapiens
cuugaaugaaacguggugg

SEQ ID NO: 1208 - RNA, 19 nt, Homo sapiens
uugaaugaaacgugguggg

SEQ ID NO: 1209 - RNA, 19 nt, Homo sapiens
ugaaugaaacguggugggu

SEQ ID NO: 1210 - RNA, 19 nt, Homo sapiens
gaaugaaacguggugggua

SEQ ID NO: 1211 - RNA, 19 nt, Homo sapiens
aaugaaacgugguggguaa

SEQ ID NO: 1212 - RNA, 19 nt, Homo sapiens
augaaacgugguggguaaa

SEQ ID NO: 1213 - RNA, 19 nt, Homo sapiens
ugaaacgugguggguaaaa

SEQ ID NO: 1214 - RNA, 19 nt, Homo sapiens
gaaacgugguggguaaaau

SEQ ID NO: 1215 - RNA, 19 nt, Homo sapiens
aaacgugguggguaaaauu

SEQ ID NO: 1216 - RNA, 19 nt, Homo sapiens
aacgugguggguaaaauuu

SEQ ID NO: 1217 - RNA, 19 nt, Homo sapiens
acgugguggguaaaauuuc

SEQ ID NO: 1218 - RNA, 19 nt, Homo sapiens
cgugguggguaaaauuucu

SEQ ID NO: 1219 - RNA, 19 nt, Homo sapiens
gugguggguaaaauuucuc

SEQ ID NO: 1220 - RNA, 19 nt, Homo sapiens
ugguggguaaaauuucucc

SEQ ID NO: 1221 - RNA, 19 nt, Homo sapiens
gguggguaaaauuucuccu

SEQ ID NO: 1222 - RNA, 19 nt, Homo sapiens
guggguaaaauuucuccug

SEQ ID NO: 1223 - RNA, 19 nt, Homo sapiens
uggguaaaauuucuccugg

SEQ ID NO: 1224 - RNA, 19 nt, Homo sapiens
ggguaaaauuucuccugga

SEQ ID NO: 1225 - RNA, 19 nt, Homo sapiens
gguaaaauuucuccuggau

SEQ ID NO: 1226 - RNA, 19 nt, Homo sapiens
guaaaauuucuccuggauu

SEQ ID NO: 1227 - RNA, 19 nt, Homo sapiens
uaaaauuucuccuggauug

SEQ ID NO: 1228 - RNA, 19 nt, Homo sapiens
aaaauuucuccuggauugc

SEQ ID NO: 1229 - RNA, 19 nt, Homo sapiens
aaauuucuccuggauugca

SEQ ID NO: 1230 - RNA, 19 nt, Homo sapiens
aauuucuccuggauugcau

SEQ ID NO: 1231 - RNA, 19 nt, Homo sapiens
auuucuccuggauugcauc

SEQ ID NO: 1232 - RNA, 19 nt, Homo sapiens
uuucuccuggauugcaucc

SEQ ID NO: 1233 - RNA, 19 nt, Homo sapiens
uucuccuggauugcauccu

SEQ ID NO: 1234 - RNA, 19 nt, Homo sapiens
ucuccuggauugcauccug

SEQ ID NO: 1235 - RNA, 19 nt, Homo sapiens
cuccuggauugcauccuga

SEQ ID NO: 1236 - RNA, 19 nt, Homo sapiens
uccuggauugcauccugau

SEQ ID NO: 1237 - RNA, 19 nt, Homo sapiens
ccuggauugcauccugauc

SEQ ID NO: 1238 - RNA, 19 nt, Homo sapiens
cuggauugcauccugauca

SEQ ID NO: 1239 - RNA, 19 nt, Homo sapiens
uggauugcauccugaucau

SEQ ID NO: 1240 - RNA, 19 nt, Homo sapiens
ggauugcauccugaucauu

SEQ ID NO: 1241 - RNA, 19 nt, Homo sapiens
gauugcauccugaucauuc

SEQ ID NO: 1242 - RNA, 19 nt, Homo sapiens
auugcauccugaucauuca

SEQ ID NO: 1243 - RNA, 19 nt, Homo sapiens
uugcauccugaucauucac

SEQ ID NO: 1244 - RNA, 19 nt, Homo sapiens
ugcauccugaucauucaca

SEQ ID NO: 1245 - RNA, 19 nt, Homo sapiens
gcauccugaucauucacau

SEQ ID NO: 1246 - RNA, 19 nt, Homo sapiens
cauccugaucauucacauc

SEQ ID NO: 1247 - RNA, 19 nt, Homo sapiens
auccugaucauucacaucu

SEQ ID NO: 1248 - RNA, 19 nt, Homo sapiens
uccugaucauucacaucuc

SEQ ID NO: 1249 - RNA, 19 nt, Homo sapiens
ccugaucauucacaucucc

SEQ ID NO: 1250 - RNA, 19 nt, Homo sapiens
cugaucauucacaucuccc

SEQ ID NO: 1251 - RNA, 19 nt, Homo sapiens
ugaucauucacaucucccc

SEQ ID NO: 1252 - RNA, 19 nt, Homo sapiens
gaucauucacaucuccccu

SEQ ID NO: 1253 - RNA, 19 nt, Homo sapiens
aucauucacaucuccccuu

SEQ ID NO: 1254 - RNA, 19 nt, Homo sapiens
ucauucacaucuccccuug

SEQ ID NO: 1255 - RNA, 19 nt, Homo sapiens
cauucacaucuccccuuga

SEQ ID NO: 1256 - RNA, 19 nt, Homo sapiens
auucacaucuccccuugag

SEQ ID NO: 1257 - RNA, 19 nt, Homo sapiens
uucacaucuccccuugagg

SEQ ID NO: 1258 - RNA, 19 nt, Homo sapiens
ucacaucuccccuugaggu

SEQ ID NO: 1259 - RNA, 19 nt, Homo sapiens
cacaucuccccuugagguu

SEQ ID NO: 1260 - RNA, 19 nt, Homo sapiens
acaucuccccuugagguug

SEQ ID NO: 1261 - RNA, 19 nt, Homo sapiens
caucuccccuugagguuga

SEQ ID NO: 1262 - RNA, 19 nt, Homo sapiens
aucuccccuugagguugau

SEQ ID NO: 1263 - RNA, 19 nt, Homo sapiens
ucuccccuugagguugauc

SEQ ID NO: 1264 - RNA, 19 nt, Homo sapiens
cuccccuugagguugaucu

SEQ ID NO: 1265 - RNA, 19 nt, Homo sapiens
uccccuugagguugaucua

SEQ ID NO: 1266 - RNA, 19 nt, Homo sapiens
ccccuugagguugaucuac

SEQ ID NO: 1267 - RNA, 19 nt, Homo sapiens
cccuugagguugaucuacu

SEQ ID NO: 1268 - RNA, 19 nt, Homo sapiens
ccuugagguugaucuacuu

SEQ ID NO: 1269 - RNA, 19 nt, Homo sapiens
cuugagguugaucuacuuc

SEQ ID NO: 1270 - RNA, 19 nt, Homo sapiens
uugagguugaucuacuucu

SEQ ID NO: 1271 - RNA, 19 nt, Homo sapiens
ugagguugaucuacuucuu

SEQ ID NO: 1272 - RNA, 19 nt, Homo sapiens
gagguugaucuacuucuua

SEQ ID NO: 1273 - RNA, 19 nt, Homo sapiens
agguugaucuacuucuuac

SEQ ID NO: 1274 - RNA, 19 nt, Homo sapiens
gguugaucuacuucuuacu

SEQ ID NO: 1275 - RNA, 19 nt, Homo sapiens
guugaucuacuucuuacuu

SEQ ID NO: 1276 - RNA, 19 nt, Homo sapiens
uugaucuacuucuuacuug

SEQ ID NO: 1277 - RNA, 19 nt, Homo sapiens
ugaucuacuucuuacuugu

SEQ ID NO: 1278 - RNA, 19 nt, Homo sapiens
gaucuacuucuuacuugug

SEQ ID NO: 1279 - RNA, 19 nt, Homo sapiens
aucuacuucuuacuuguga

SEQ ID NO: 1280 - RNA, 19 nt, Homo sapiens
ucuacuucuuacuugugau

SEQ ID NO: 1281 - RNA, 19 nt, Homo sapiens
cuacuucuuacuugugaug

SEQ ID NO: 1282 - RNA, 19 nt, Homo sapiens
uacuucuuacuugugaugu

SEQ ID NO: 1283 - RNA, 19 nt, Homo sapiens
acuucuuacuugugaugua

SEQ ID NO: 1284 - RNA, 19 nt, Homo sapiens
cuucuuacuugugauguag

SEQ ID NO: 1285 - RNA, 19 nt, Homo sapiens
uucuuacuugugauguagg

SEQ ID NO: 1286 - RNA, 19 nt, Homo sapiens
ucuuacuugugauguagga

SEQ ID NO: 1287 - RNA, 19 nt, Homo sapiens
cuuacuugugauguaggaa

SEQ ID NO: 1288 - RNA, 19 nt, Homo sapiens
uuacuugugauguaggaac

SEQ ID NO: 1289 - RNA, 19 nt, Homo sapiens
uacuugugauguaggaacu

SEQ ID NO: 1290 - RNA, 19 nt, Homo sapiens
acuugugauguaggaacuu

SEQ ID NO: 1291 - RNA, 19 nt, Homo sapiens
cuugugauguaggaacuug

SEQ ID NO: 1292 - RNA, 19 nt, Homo sapiens
uugugauguaggaacuugc

SEQ ID NO: 1293 - RNA, 19 nt, Homo sapiens
ugugauguaggaacuugca

SEQ ID NO: 1294 - RNA, 19 nt, Homo sapiens
gugauguaggaacuugcag

SEQ ID NO: 1295 - RNA, 19 nt, Homo sapiens
ugauguaggaacuugcagu

SEQ ID NO: 1296 - RNA, 19 nt, Homo sapiens
gauguaggaacuugcaguc

SEQ ID NO: 1297 - RNA, 19 nt, Homo sapiens
auguaggaacuugcagucg

SEQ ID NO: 1298 - RNA, 19 nt, Homo sapiens
uguaggaacuugcagucgc

SEQ ID NO: 1299 - RNA, 19 nt, Homo sapiens
guaggaacuugcagucgcg

SEQ ID NO: 1300 - RNA, 19 nt, Homo sapiens
uaggaacuugcagucgcgc

SEQ ID NO: 1301 - RNA, 19 nt, Homo sapiens
aggaacuugcagucgcgca

SEQ ID NO: 1302 - RNA, 19 nt, Homo sapiens
ggaacuugcagucgcgcau

SEQ ID NO: 1303 - RNA, 19 nt, Homo sapiens
gaacuugcagucgcgcaug

SEQ ID NO: 1304 - RNA, 19 nt, Homo sapiens
aacuugcagucgcgcaugu

SEQ ID NO: 1305 - RNA, 19 nt, Homo sapiens
acuugcagucgcgcauguu

SEQ ID NO: 1306 - RNA, 19 nt, Homo sapiens
cuugcagucgcgcauguuc

SEQ ID NO: 1307 - RNA, 19 nt, Homo sapiens
uugcagucgcgcauguucu

SEQ ID NO: 1308 - RNA, 19 nt, Homo sapiens
ugcagucgcgcauguucug

SEQ ID NO: 1309 - RNA, 19 nt, Homo sapiens
gcagucgcgcauguucuga

SEQ ID NO: 1310 - RNA, 19 nt, Homo sapiens
cagucgcgcauguucugag

SEQ ID NO: 1311 - RNA, 19 nt, Homo sapiens
agucgcgcauguucugagu

SEQ ID NO: 1312 - RNA, 19 nt, Homo sapiens
gucgcgcauguucugaguu

SEQ ID NO: 1313 - RNA, 19 nt, Homo sapiens
ucgcgcauguucugaguug

SEQ ID NO: 1314 - RNA, 19 nt, Homo sapiens
cgcgcauguucugaguugu

SEQ ID NO: 1315 - RNA, 19 nt, Homo sapiens
gcgcauguucugaguugug

SEQ ID NO: 1316 - RNA, 19 nt, Homo sapiens
cgcauguucugaguugugu

SEQ ID NO: 1317 - RNA, 19 nt, Homo sapiens
gcauguucugaguuguguu

SEQ ID NO: 1318 - RNA, 19 nt, Homo sapiens
cauguucugaguuguguug

SEQ ID NO: 1319 - RNA, 19 nt, Homo sapiens
auguucugaguuguguugc

SEQ ID NO: 1320 - RNA, 19 nt, Homo sapiens
uguucugaguuguguugcu

SEQ ID NO: 1321 - RNA, 19 nt, Homo sapiens
guucugaguuguguugcug

SEQ ID NO: 1322 - RNA, 19 nt, Homo sapiens
uucugaguuguguugcugc

SEQ ID NO: 1323 - RNA, 19 nt, Homo sapiens
ucugaguuguguugcugcg

SEQ ID NO: 1324 - RNA, 19 nt, Homo sapiens
cugaguuguguugcugcga

SEQ ID NO: 1325 - RNA, 19 nt, Homo sapiens
ugaguuguguugcugcgag

SEQ ID NO: 1326 - RNA, 19 nt, Homo sapiens
gaguuguguugcugcgagu

SEQ ID NO: 1327 - RNA, 19 nt, Homo sapiens
aguuguguugcugcgaguc

SEQ ID NO: 1328 - RNA, 19 nt, Homo sapiens
guuguguugcugcgagucu

SEQ ID NO: 1329 - RNA, 19 nt, Homo sapiens
uuguguugcugcgagucuu

SEQ ID NO: 1330 - RNA, 19 nt, Homo sapiens
uguguugcugcgagucuug

SEQ ID NO: 1331 - RNA, 19 nt, Homo sapiens
guguugcugcgagucuugu

SEQ ID NO: 1332 - RNA, 19 nt, Homo sapiens
uguugcugcgagucuugug

SEQ ID NO: 1333 - RNA, 19 nt, Homo sapiens
guugcugcgagucuugugc

SEQ ID NO: 1334 - RNA, 19 nt, Homo sapiens
uugcugcgagucuugugca

SEQ ID NO: 1335 - RNA, 19 nt, Homo sapiens
ugcugcgagucuugugcac

SEQ ID NO: 1336 - RNA, 19 nt, Homo sapiens
gcugcgagucuugugcacc

SEQ ID NO: 1337 - RNA, 19 nt, Homo sapiens
cugcgagucuugugcacca

SEQ ID NO: 1338 - RNA, 19 nt, Homo sapiens
ugcgagucuugugcaccac

SEQ ID NO: 1339 - RNA, 19 nt, Homo sapiens
gcgagucuugugcaccacu

SEQ ID NO: 1340 - RNA, 19 nt, Homo sapiens
cgagucuugugcaccacug

SEQ ID NO: 1341 - RNA, 19 nt, Homo sapiens
gagucuugugcaccacugu

SEQ ID NO: 1342 - RNA, 19 nt, Homo sapiens
agucuugugcaccacuguc

SEQ ID NO: 1343 - RNA, 19 nt, Homo sapiens
gucuugugcaccacuguca

SEQ ID NO: 1344 - RNA, 19 nt, Homo sapiens
ucuugugcaccacugucau

SEQ ID NO: 1345 - RNA, 19 nt, Homo sapiens
cuugugcaccacugucauc

SEQ ID NO: 1346 - RNA, 19 nt, Homo sapiens
uugugcaccacugucaucc

SEQ ID NO: 1347 - RNA, 19 nt, Homo sapiens
ugugcaccacugucauccu

SEQ ID NO: 1348 - RNA, 19 nt, Homo sapiens
gugcaccacugucauccug

SEQ ID NO: 1349 - RNA, 19 nt, Homo sapiens
ugcaccacugucauccuga

SEQ ID NO: 1350 - RNA, 19 nt, Homo sapiens
gcaccacugucauccugag

SEQ ID NO: 1351 - RNA, 19 nt, Homo sapiens
caccacugucauccugagc

SEQ ID NO: 1352 - RNA, 19 nt, Homo sapiens
accacugucauccugagcu

SEQ ID NO: 1353 - RNA, 19 nt, Homo sapiens
ccacugucauccugagcuu

SEQ ID NO: 1354 - RNA, 19 nt, Homo sapiens
cacugucauccugagcuug

SEQ ID NO: 1355 - RNA, 19 nt, Homo sapiens
acugucauccugagcuuga

SEQ ID NO: 1356 - RNA, 19 nt, Homo sapiens
cugucauccugagcuugaa

SEQ ID NO: 1357 - RNA, 19 nt, Homo sapiens
ugucauccugagcuugaaa

SEQ ID NO: 1358 - RNA, 19 nt, Homo sapiens
gucauccugagcuugaaac

SEQ ID NO: 1359 - RNA, 19 nt, Homo sapiens
ucauccugagcuugaaaca

SEQ ID NO: 1360 - RNA, 19 nt, Homo sapiens
cauccugagcuugaaacac

SEQ ID NO: 1361 - RNA, 19 nt, Homo sapiens
auccugagcuugaaacaca

SEQ ID NO: 1362 - RNA, 19 nt, Homo sapiens
uccugagcuugaaacacag

SEQ ID NO: 1363 - RNA, 19 nt, Homo sapiens
ccugagcuugaaacacagc

SEQ ID NO: 1364 - RNA, 19 nt, Homo sapiens
cugagcuugaaacacagca

SEQ ID NO: 1365 - RNA, 19 nt, Homo sapiens
ugagcuugaaacacagcag

SEQ ID NO: 1366 - RNA, 19 nt, Homo sapiens
gagcuugaaacacagcagc

SEQ ID NO: 1367 - RNA, 19 nt, Homo sapiens
agcuugaaacacagcagcu

SEQ ID NO: 1368 - RNA, 19 nt, Homo sapiens
gcuugaaacacagcagcug

SEQ ID NO: 1369 - RNA, 19 nt, Homo sapiens
cuugaaacacagcagcugc

SEQ ID NO: 1370 - RNA, 19 nt, Homo sapiens
uugaaacacagcagcugca

SEQ ID NO: 1371 - RNA, 19 nt, Homo sapiens
ugaaacacagcagcugcau

SEQ ID NO: 1372 - RNA, 19 nt, Homo sapiens
gaaacacagcagcugcauu

SEQ ID NO: 1373 - RNA, 19 nt, Homo sapiens
aaacacagcagcugcauuc

SEQ ID NO: 1374 - RNA, 19 nt, Homo sapiens
aacacagcagcugcauucu

SEQ ID NO: 1375 - RNA, 19 nt, Homo sapiens
acacagcagcugcauucug

SEQ ID NO: 1376 - RNA, 19 nt, Homo sapiens
cacagcagcugcauucugu

SEQ ID NO: 1377 - RNA, 19 nt, Homo sapiens
acagcagcugcauucugug

SEQ ID NO: 1378 - RNA, 19 nt, Homo sapiens
cagcagcugcauucugugg

SEQ ID NO: 1379 - RNA, 19 nt, Homo sapiens
agcagcugcauucuguggu

SEQ ID NO: 1380 - RNA, 19 nt, Homo sapiens
gcagcugcauucugugguc

SEQ ID NO: 1381 - RNA, 19 nt, Homo sapiens
cagcugcauucuguggucc

SEQ ID NO: 1382 - RNA, 19 nt, Homo sapiens
agcugcauucugugguccu

SEQ ID NO: 1383 - RNA, 19 nt, Homo sapiens
gcugcauucugugguccua

SEQ ID NO: 1384 - RNA, 19 nt, Homo sapiens
cugcauucugugguccuag

SEQ ID NO: 1385 - RNA, 19 nt, Homo sapiens
ugcauucugugguccuagc

SEQ ID NO: 1386 - RNA, 19 nt, Homo sapiens
gcauucugugguccuagca

SEQ ID NO: 1387 - RNA, 19 nt, Homo sapiens
cauucugugguccuagcaa

SEQ ID NO: 1388 - RNA, 19 nt, Homo sapiens
auucugugguccuagcaau

SEQ ID NO: 1389 - RNA, 19 nt, Homo sapiens
uucugugguccuagcaauc

SEQ ID NO: 1390 - RNA, 19 nt, Homo sapiens
ucugugguccuagcaaucu

SEQ ID NO: 1391 - RNA, 19 nt, Homo sapiens
cugugguccuagcaaucug

SEQ ID NO: 1392 - RNA, 19 nt, Homo sapiens
ugugguccuagcaaucugc

SEQ ID NO: 1393 - RNA, 19 nt, Homo sapiens
gugguccuagcaaucugcg

SEQ ID NO: 1394 - RNA, 19 nt, Homo sapiens
ugguccuagcaaucugcga

SEQ ID NO: 1395 - RNA, 19 nt, Homo sapiens
gguccuagcaaucugcgag

SEQ ID NO: 1396 - RNA, 19 nt, Homo sapiens
guccuagcaaucugcgagc

SEQ ID NO: 1397 - RNA, 19 nt, Homo sapiens
uccuagcaaucugcgagcc

SEQ ID NO: 1398 - RNA, 19 nt, Homo sapiens
ccuagcaaucugcgagcca

SEQ ID NO: 1399 - RNA, 19 nt, Homo sapiens
cuagcaaucugcgagccau

SEQ ID NO: 1400 - RNA, 19 nt, Homo sapiens
uagcaaucugcgagccauc

SEQ ID NO: 1401 - RNA, 19 nt, Homo sapiens
agcaaucugcgagccaucu

SEQ ID NO: 1402 - RNA, 19 nt, Homo sapiens
gcaaucugcgagccaucuu

SEQ ID NO: 1403 - RNA, 19 nt, Homo sapiens
caaucugcgagccaucuuc

SEQ ID NO: 1404 - RNA, 19 nt, Homo sapiens
aaucugcgagccaucuucu

SEQ ID NO: 1405 - RNA, 19 nt, Homo sapiens
aucugcgagccaucuucuc

SEQ ID NO: 1406 - RNA, 19 nt, Homo sapiens
ucugcgagccaucuucucu

SEQ ID NO: 1407 - RNA, 19 nt, Homo sapiens
cugcgagccaucuucucuu

SEQ ID NO: 1408 - RNA, 19 nt, Homo sapiens
ugcgagccaucuucucuuc

SEQ ID NO: 1409 - RNA, 19 nt, Homo sapiens
gcgagccaucuucucuuca

SEQ ID NO: 1410 - RNA, 19 nt, Homo sapiens
cgagccaucuucucuucau

SEQ ID NO: 1411 - RNA, 19 nt, Homo sapiens
gagccaucuucucuucaua

SEQ ID NO: 1412 - RNA, 19 nt, Homo sapiens
agccaucuucucuucauau

SEQ ID NO: 1413 - RNA, 19 nt, Homo sapiens
gccaucuucucuucauaug

SEQ ID NO: 1414 - RNA, 19 nt, Homo sapiens
ccaucuucucuucauaugu

SEQ ID NO: 1415 - RNA, 19 nt, Homo sapiens
caucuucucuucauauguu

SEQ ID NO: 1416 - RNA, 19 nt, Homo sapiens
aucuucucuucauauguua

SEQ ID NO: 1417 - RNA, 19 nt, Homo sapiens
ucuucucuucauauguuag

SEQ ID NO: 1418 - RNA, 19 nt, Homo sapiens
cuucucuucauauguuaga

SEQ ID NO: 1419 - RNA, 19 nt, Homo sapiens
uucucuucauauguuagac

SEQ ID NO: 1420 - RNA, 19 nt, Homo sapiens
ucucuucauauguuagacg

SEQ ID NO: 1421 - RNA, 19 nt, Homo sapiens
cucuucauauguuagacgu

SEQ ID NO: 1422 - RNA, 19 nt, Homo sapiens
ucuucauauguuagacguu

SEQ ID NO: 1423 - RNA, 19 nt, Homo sapiens
cuucauauguuagacguug

SEQ ID NO: 1424 - RNA, 19 nt, Homo sapiens
uucauauguuagacguuga

SEQ ID NO: 1425 - RNA, 19 nt, Homo sapiens
ucauauguuagacguugau

SEQ ID NO: 1426 - RNA, 19 nt, Homo sapiens
cauauguuagacguugauu

SEQ ID NO: 1427 - RNA, 19 nt, Homo sapiens
auauguuagacguugauuu

SEQ ID NO: 1428 - RNA, 19 nt, Homo sapiens
uauguuagacguugauuuc

SEQ ID NO: 1429 - RNA, 19 nt, Homo sapiens
auguuagacguugauuucc

SEQ ID NO: 1430 - RNA, 19 nt, Homo sapiens
uguuagacguugauuucca

SEQ ID NO: 1431 - RNA, 19 nt, Homo sapiens
guuagacguugauuuccau

SEQ ID NO: 1432 - RNA, 19 nt, Homo sapiens
uuagacguugauuuccauu

SEQ ID NO: 1433 - RNA, 19 nt, Homo sapiens
uagacguugauuuccauua

SEQ ID NO: 1434 - RNA, 19 nt, Homo sapiens
agacguugauuuccauuau

SEQ ID NO: 1435 - RNA, 19 nt, Homo sapiens
gacguugauuuccauuaug

SEQ ID NO: 1436 - RNA, 19 nt, Homo sapiens
acguugauuuccauuauga

SEQ ID NO: 1437 - RNA, 19 nt, Homo sapiens
cguugauuuccauuaugaa

SEQ ID NO: 1438 - RNA, 19 nt, Homo sapiens
guugauuuccauuaugaag

SEQ ID NO: 1439 - RNA, 19 nt, Homo sapiens
uugauuuccauuaugaaga

SEQ ID NO: 1440 - RNA, 19 nt, Homo sapiens
ugauuuccauuaugaagaa

SEQ ID NO: 1441 - RNA, 19 nt, Homo sapiens
gauuuccauuaugaagaag

SEQ ID NO: 1442 - RNA, 19 nt, Homo sapiens
auuuccauuaugaagaagg

SEQ ID NO: 1443 - RNA, 19 nt, Homo sapiens
uuuccauuaugaagaaggg

SEQ ID NO: 1444 - RNA, 19 nt, Homo sapiens
uuccauuaugaagaagggu

SEQ ID NO: 1445 - RNA, 19 nt, Homo sapiens
uccauuaugaagaagggug

SEQ ID NO: 1446 - RNA, 19 nt, Homo sapiens
ccauuaugaagaagggugu

SEQ ID NO: 1447 - RNA, 19 nt, Homo sapiens
cauuaugaagaaggguguc

SEQ ID NO: 1448 - RNA, 19 nt, Homo sapiens
auuaugaagaagggugucc

SEQ ID NO: 1449 - RNA, 19 nt, Homo sapiens
uuaugaagaaggguguccu

SEQ ID NO: 1450 - RNA, 19 nt, Homo sapiens
uaugaagaaggguguccuu

SEQ ID NO: 1451 - RNA, 19 nt, Homo sapiens
augaagaaggguguccuug

SEQ ID NO: 1452 - RNA, 19 nt, Homo sapiens
ugaagaaggguguccuugc

SEQ ID NO: 1453 - RNA, 19 nt, Homo sapiens
gaagaaggguguccuugca

SEQ ID NO: 1454 - RNA, 19 nt, Homo sapiens
aagaaggguguccuugcau

SEQ ID NO: 1455 - RNA, 19 nt, Homo sapiens
agaaggguguccuugcauu

SEQ ID NO: 1456 - RNA, 19 nt, Homo sapiens
gaaggguguccuugcauuu

SEQ ID NO: 1457 - RNA, 19 nt, Homo sapiens
aaggguguccuugcauuuc

SEQ ID NO: 1458 - RNA, 19 nt, Homo sapiens
aggguguccuugcauuuca

SEQ ID NO: 1459 - RNA, 19 nt, Homo sapiens
ggguguccuugcauuucag

SEQ ID NO: 1460 - RNA, 19 nt, Homo sapiens
gguguccuugcauuucagc

SEQ ID NO: 1461 - RNA, 19 nt, Homo sapiens
guguccuugcauuucagcu

SEQ ID NO: 1462 - RNA, 19 nt, Homo sapiens
uguccuugcauuucagcuu

SEQ ID NO: 1463 - RNA, 19 nt, Homo sapiens
guccuugcauuucagcuuu

SEQ ID NO: 1464 - RNA, 19 nt, Homo sapiens
uccuugcauuucagcuuuc

SEQ ID NO: 1465 - RNA, 19 nt, Homo sapiens
ccuugcauuucagcuuucu

SEQ ID NO: 1466 - RNA, 19 nt, Homo sapiens
cuugcauuucagcuuucuu

SEQ ID NO: 1467 - RNA, 19 nt, Homo sapiens
uugcauuucagcuuucuuu

SEQ ID NO: 1468 - RNA, 19 nt, Homo sapiens
ugcauuucagcuuucuuuc

SEQ ID NO: 1469 - RNA, 19 nt, Homo sapiens
gcauuucagcuuucuuucc

SEQ ID NO: 1470 - RNA, 19 nt, Homo sapiens
cauuucagcuuucuuucca

SEQ ID NO: 1471 - RNA, 19 nt, Homo sapiens
auuucagcuuucuuuccaa

SEQ ID NO: 1472 - RNA, 19 nt, Homo sapiens
uuucagcuuucuuuccaaa

SEQ ID NO: 1473 - RNA, 19 nt, Homo sapiens
uucagcuuucuuuccaaau

SEQ ID NO: 1474 - RNA, 19 nt, Homo sapiens
ucagcuuucuuuccaaauc

SEQ ID NO: 1475 - RNA, 19 nt, Homo sapiens
cagcuuucuuuccaaaucu

SEQ ID NO: 1476 - RNA, 19 nt, Homo sapiens
agcuuucuuuccaaaucuu

SEQ ID NO: 1477 - RNA, 19 nt, Homo sapiens
gcuuucuuuccaaaucuug

SEQ ID NO: 1478 - RNA, 19 nt, Homo sapiens
cuuucuuuccaaaucuuga

SEQ ID NO: 1479 - RNA, 19 nt, Homo sapiens
uuucuuuccaaaucuugaa

SEQ ID NO: 1480 - RNA, 19 nt, Homo sapiens
uucuuuccaaaucuugaau

SEQ ID NO: 1481 - RNA, 19 nt, Homo sapiens
ucuuuccaaaucuugaauc

SEQ ID NO: 1482 - RNA, 19 nt, Homo sapiens
cuuuccaaaucuugaauca

SEQ ID NO: 1483 - RNA, 19 nt, Homo sapiens
uuuccaaaucuugaaucaa

SEQ ID NO: 1484 - RNA, 19 nt, Homo sapiens
uuccaaaucuugaaucaaa

SEQ ID NO: 1485 - RNA, 19 nt, Homo sapiens
uccaaaucuugaaucaaag

SEQ ID NO: 1486 - RNA, 19 nt, Homo sapiens
ccaaaucuugaaucaaagc

SEQ ID NO: 1487 - RNA, 19 nt, Homo sapiens
caaaucuugaaucaaagcu

SEQ ID NO: 1488 - RNA, 19 nt, Homo sapiens
aaaucuugaaucaaagcuu

SEQ ID NO: 1489 - RNA, 19 nt, Homo sapiens
aaucuugaaucaaagcuuc

SEQ ID NO: 1490 - RNA, 19 nt, Homo sapiens
aucuugaaucaaagcuucu

SEQ ID NO: 1491 - RNA, 19 nt, Homo sapiens
ucuugaaucaaagcuucuu

SEQ ID NO: 1492 - RNA, 19 nt, Homo sapiens
cuugaaucaaagcuucuuu

SEQ ID NO: 1493 - RNA, 19 nt, Homo sapiens
uugaaucaaagcuucuuuu

SEQ ID NO: 1494 - RNA, 19 nt, Homo sapiens
ugaaucaaagcuucuuuug

SEQ ID NO: 1495 - RNA, 19 nt, Homo sapiens
gaaucaaagcuucuuuuga

SEQ ID NO: 1496 - RNA, 19 nt, Homo sapiens
aaucaaagcuucuuuugau

SEQ ID NO: 1497 - RNA, 19 nt, Homo sapiens
aucaaagcuucuuuugauc

SEQ ID NO: 1498 - RNA, 19 nt, Homo sapiens
ucaaagcuucuuuugaucc

SEQ ID NO: 1499 - RNA, 19 nt, Homo sapiens
caaagcuucuuuugauccu

SEQ ID NO: 1500 - RNA, 19 nt, Homo sapiens
aaagcuucuuuugauccuu

SEQ ID NO: 1501 - RNA, 19 nt, Homo sapiens
aagcuucuuuugauccuug

SEQ ID NO: 1502 - RNA, 19 nt, Homo sapiens
agcuucuuuugauccuugu

SEQ ID NO: 1503 - RNA, 19 nt, Homo sapiens
gcuucuuuugauccuugua

SEQ ID NO: 1504 - RNA, 19 nt, Homo sapiens
cuucuuuugauccuuguau

SEQ ID NO: 1505 - RNA, 19 nt, Homo sapiens
uucuuuugauccuuguauu

SEQ ID NO: 1506 - RNA, 19 nt, Homo sapiens
ucuuuugauccuuguauuu

SEQ ID NO: 1507 - RNA, 19 nt, Homo sapiens
cuuuugauccuuguauuuc

SEQ ID NO: 1508 - RNA, 19 nt, Homo sapiens
uuuugauccuuguauuuca

SEQ ID NO: 1509 - RNA, 19 nt, Homo sapiens
uuugauccuuguauuucau

SEQ ID NO: 1510 - RNA, 19 nt, Homo sapiens
uugauccuuguauuucaug

SEQ ID NO: 1511 - RNA, 19 nt, Homo sapiens
ugauccuuguauuucauga

SEQ ID NO: 1512 - RNA, 19 nt, Homo sapiens
gauccuuguauuucaugau

SEQ ID NO: 1513 - RNA, 19 nt, Homo sapiens
auccuuguauuucaugauc

SEQ ID NO: 1514 - RNA, 19 nt, Homo sapiens
uccuuguauuucaugauca

SEQ ID NO: 1515 - RNA, 19 nt, Homo sapiens
ccuuguauuucaugaucag

SEQ ID NO: 1516 - RNA, 19 nt, Homo sapiens
cuuguauuucaugaucagg

SEQ ID NO: 1517 - RNA, 19 nt, Homo sapiens
uuguauuucaugaucagga

SEQ ID NO: 1518 - RNA, 19 nt, Homo sapiens
uguauuucaugaucaggag

SEQ ID NO: 1519 - RNA, 19 nt, Homo sapiens
guauuucaugaucaggagu

SEQ ID NO: 1520 - RNA, 19 nt, Homo sapiens
uauuucaugaucaggaguu

SEQ ID NO: 1521 - RNA, 19 nt, Homo sapiens
auuucaugaucaggaguuc

SEQ ID NO: 1522 - RNA, 19 nt, Homo sapiens
uuucaugaucaggaguucu

SEQ ID NO: 1523 - RNA, 19 nt, Homo sapiens
uucaugaucaggaguucuu

SEQ ID NO: 1524 - RNA, 19 nt, Homo sapiens
ucaugaucaggaguucuug

SEQ ID NO: 1525 - RNA, 19 nt, Homo sapiens
caugaucaggaguucuugg

SEQ ID NO: 1526 - RNA, 19 nt, Homo sapiens
augaucaggaguucuuggu

SEQ ID NO: 1527 - RNA, 19 nt, Homo sapiens
ugaucaggaguucuuggua

SEQ ID NO: 1528 - RNA, 19 nt, Homo sapiens
gaucaggaguucuugguau

SEQ ID NO: 1529 - RNA, 19 nt, Homo sapiens
aucaggaguucuugguaug

SEQ ID NO: 1530 - RNA, 19 nt, Homo sapiens
ucaggaguucuugguaugg

SEQ ID NO: 1531 - RNA, 19 nt, Homo sapiens
caggaguucuugguauggg

SEQ ID NO: 1532 - RNA, 19 nt, Homo sapiens
aggaguucuugguaugggc

SEQ ID NO: 1533 - RNA, 19 nt, Homo sapiens
ggaguucuugguaugggcu

SEQ ID NO: 1534 - RNA, 19 nt, Homo sapiens
gaguucuugguaugggcuu

SEQ ID NO: 1535 - RNA, 19 nt, Homo sapiens
aguucuugguaugggcuua

SEQ ID NO: 1536 - RNA, 19 nt, Homo sapiens
guucuugguaugggcuuag

SEQ ID NO: 1537 - RNA, 19 nt, Homo sapiens
uucuugguaugggcuuagc

SEQ ID NO: 1538 - RNA, 19 nt, Homo sapiens
ucuugguaugggcuuagca

SEQ ID NO: 1539 - RNA, 19 nt, Homo sapiens
cuugguaugggcuuagcau

SEQ ID NO: 1540 - RNA, 19 nt, Homo sapiens
uugguaugggcuuagcauu

SEQ ID NO: 1541 - RNA, 19 nt, Homo sapiens
ugguaugggcuuagcauuu

SEQ ID NO: 1542 - RNA, 19 nt, Homo sapiens
gguaugggcuuagcauuug

SEQ ID NO: 1543 - RNA, 19 nt, Homo sapiens
guaugggcuuagcauuugc

SEQ ID NO: 1544 - RNA, 19 nt, Homo sapiens
uaugggcuuagcauuugca

SEQ ID NO: 1545 - RNA, 19 nt, Homo sapiens
augggcuuagcauuugcag

SEQ ID NO: 1546 - RNA, 19 nt, Homo sapiens
ugggcuuagcauuugcagu

SEQ ID NO: 1547 - RNA, 19 nt, Homo sapiens
gggcuuagcauuugcaguu

SEQ ID NO: 1548 - RNA, 19 nt, Homo sapiens
ggcuuagcauuugcaguuu

SEQ ID NO: 1549 - RNA, 19 nt, Homo sapiens
gcuuagcauuugcaguuug

SEQ ID NO: 1550 - RNA, 19 nt, Homo sapiens
cuuagcauuugcaguuugg

SEQ ID NO: 1551 - RNA, 19 nt, Homo sapiens
uuagcauuugcaguuuggg

SEQ ID NO: 1552 - RNA, 19 nt, Homo sapiens
uagcauuugcaguuuggga

SEQ ID NO: 1553 - RNA, 19 nt, Homo sapiens
agcauuugcaguuugggau

SEQ ID NO: 1554 - RNA, 19 nt, Homo sapiens
gcauuugcaguuugggaug

SEQ ID NO: 1555 - RNA, 19 nt, Homo sapiens
cauuugcaguuugggaugg

SEQ ID NO: 1556 - RNA, 19 nt, Homo sapiens
auuugcaguuugggauggc

SEQ ID NO: 1557 - RNA, 19 nt, Homo sapiens
uuugcaguuugggauggcu

SEQ ID NO: 1558 - RNA, 19 nt, Homo sapiens
uugcaguuugggauggcuu

SEQ ID NO: 1559 - RNA, 19 nt, Homo sapiens
ugcaguuugggauggcuuu

SEQ ID NO: 1560 - RNA, 19 nt, Homo sapiens
gcaguuugggauggcuuug

SEQ ID NO: 1561 - RNA, 19 nt, Homo sapiens
caguuugggauggcuuugc

SEQ ID NO: 1562 - RNA, 19 nt, Homo sapiens
aguuugggauggcuuugca

SEQ ID NO: 1563 - RNA, 19 nt, Homo sapiens
guuugggauggcuuugcau

SEQ ID NO: 1564 - RNA, 19 nt, Homo sapiens
uuugggauggcuuugcauu

SEQ ID NO: 1565 - RNA, 19 nt, Homo sapiens
uugggauggcuuugcauuu

SEQ ID NO: 1566 - RNA, 19 nt, Homo sapiens
ugggauggcuuugcauuua

SEQ ID NO: 1567 - RNA, 19 nt, Homo sapiens
gggauggcuuugcauuuau

SEQ ID NO: 1568 - RNA, 19 nt, Homo sapiens
ggauggcuuugcauuuaua

SEQ ID NO: 1569 - RNA, 19 nt, Homo sapiens
gauggcuuugcauuuauag

SEQ ID NO: 1570 - RNA, 19 nt, Homo sapiens
auggcuuugcauuuauagg

SEQ ID NO: 1571 - RNA, 19 nt, Homo sapiens
uggcuuugcauuuauaggu

SEQ ID NO: 1572 - RNA, 19 nt, Homo sapiens
ggcuuugcauuuauagguu

SEQ ID NO: 1573 - RNA, 19 nt, Homo sapiens
gcuuugcauuuauagguug

SEQ ID NO: 1574 - RNA, 19 nt, Homo sapiens
cuuugcauuuauagguugg

SEQ ID NO: 1575 - RNA, 19 nt, Homo sapiens
uuugcauuuauagguuggc

SEQ ID NO: 1576 - RNA, 19 nt, Homo sapiens
uugcauuuauagguuggcc

SEQ ID NO: 1577 - RNA, 19 nt, Homo sapiens
ugcauuuauagguuggcca

SEQ ID NO: 1578 - RNA, 19 nt, Homo sapiens
gcauuuauagguuggccag

SEQ ID NO: 1579 - RNA, 19 nt, Homo sapiens
cauuuauagguuggccagc

SEQ ID NO: 1580 - RNA, 19 nt, Homo sapiens
auuuauagguuggccagcu

SEQ ID NO: 1581 - RNA, 19 nt, Homo sapiens
uuuauagguuggccagcug

SEQ ID NO: 1582 - RNA, 19 nt, Homo sapiens
uuauagguuggccagcuga

SEQ ID NO: 1583 - RNA, 19 nt, Homo sapiens
uauagguuggccagcugag

SEQ ID NO: 1584 - RNA, 19 nt, Homo sapiens
auagguuggccagcugagg

SEQ ID NO: 1585 - RNA, 19 nt, Homo sapiens
uagguuggccagcugagga

SEQ ID NO: 1586 - RNA, 19 nt, Homo sapiens
agguuggccagcugaggac

SEQ ID NO: 1587 - RNA, 19 nt, Homo sapiens
gguuggccagcugaggacu

SEQ ID NO: 1588 - RNA, 19 nt, Homo sapiens
guuggccagcugaggacug

SEQ ID NO: 1589 - RNA, 19 nt, Homo sapiens
uuggccagcugaggacugu

SEQ ID NO: 1590 - RNA, 19 nt, Homo sapiens
uggccagcugaggacuguu

SEQ ID NO: 1591 - RNA, 19 nt, Homo sapiens
ggccagcugaggacuguug

SEQ ID NO: 1592 - RNA, 19 nt, Homo sapiens
gccagcugaggacuguuga

SEQ ID NO: 1593 - RNA, 19 nt, Homo sapiens
ccagcugaggacuguugau

SEQ ID NO: 1594 - RNA, 19 nt, Homo sapiens
cagcugaggacuguugaua

SEQ ID NO: 1595 - RNA, 19 nt, Homo sapiens
agcugaggacuguugauag

SEQ ID NO: 1596 - RNA, 19 nt, Homo sapiens
gcugaggacuguugauagu

SEQ ID NO: 1597 - RNA, 19 nt, Homo sapiens
cugaggacuguugauaguu

SEQ ID NO: 1598 - RNA, 19 nt, Homo sapiens
ugaggacuguugauaguug

SEQ ID NO: 1599 - RNA, 19 nt, Homo sapiens
gaggacuguugauaguugg

SEQ ID NO: 1600 - RNA, 19 nt, Homo sapiens
aggacuguugauaguugga

SEQ ID NO: 1601 - RNA, 19 nt, Homo sapiens
ggacuguugauaguuggaa

SEQ ID NO: 1602 - RNA, 19 nt, Homo sapiens
gacuguugauaguuggaau

SEQ ID NO: 1603 - RNA, 19 nt, Homo sapiens
acuguugauaguuggaauc

SEQ ID NO: 1604 - RNA, 19 nt, Homo sapiens
cuguugauaguuggaaucc

SEQ ID NO: 1605 - RNA, 19 nt, Homo sapiens
uguugauaguuggaaucca

SEQ ID NO: 1606 - RNA, 19 nt, Homo sapiens
guugauaguuggaauccau

SEQ ID NO: 1607 - RNA, 19 nt, Homo sapiens
uugauaguuggaauccaua

SEQ ID NO: 1608 - RNA, 19 nt, Homo sapiens
ugauaguuggaauccauag

SEQ ID NO: 1609 - RNA, 19 nt, Homo sapiens
gauaguuggaauccauagc

SEQ ID NO: 1610 - RNA, 19 nt, Homo sapiens
auaguuggaauccauagcg

SEQ ID NO: 1611 - RNA, 19 nt, Homo sapiens
uaguuggaauccauagcgg

SEQ ID NO: 1612 - RNA, 19 nt, Homo sapiens
aguuggaauccauagcgga

SEQ ID NO: 1613 - RNA, 19 nt, Homo sapiens
guuggaauccauagcggaa

SEQ ID NO: 1614 - RNA, 19 nt, Homo sapiens
uuggaauccauagcggaag

SEQ ID NO: 1615 - RNA, 19 nt, Homo sapiens
uggaauccauagcggaagg

SEQ ID NO: 1616 - RNA, 19 nt, Homo sapiens
ggaauccauagcggaaggg

SEQ ID NO: 1617 - RNA, 19 nt, Homo sapiens
gaauccauagcggaaggga

SEQ ID NO: 1618 - RNA, 19 nt, Homo sapiens
aauccauagcggaagggau

SEQ ID NO: 1619 - RNA, 19 nt, Homo sapiens
auccauagcggaagggauu

SEQ ID NO: 1620 - RNA, 19 nt, Homo sapiens
uccauagcggaagggauuu

SEQ ID NO: 1621 - RNA, 19 nt, Homo sapiens
ccauagcggaagggauuuu

SEQ ID NO: 1622 - RNA, 19 nt, Homo sapiens
cauagcggaagggauuuua

SEQ ID NO: 1623 - RNA, 19 nt, Homo sapiens
auagcggaagggauuuuac

SEQ ID NO: 1624 - RNA, 19 nt, Homo sapiens
uagcggaagggauuuuacu

SEQ ID NO: 1625 - RNA, 19 nt, Homo sapiens
agcggaagggauuuuacug

SEQ ID NO: 1626 - RNA, 19 nt, Homo sapiens
gcggaagggauuuuacugc

SEQ ID NO: 1627 - RNA, 19 nt, Homo sapiens
cggaagggauuuuacugcu

SEQ ID NO: 1628 - RNA, 19 nt, Homo sapiens
ggaagggauuuuacugcua

SEQ ID NO: 1629 - RNA, 19 nt, Homo sapiens
gaagggauuuuacugcuau

SEQ ID NO: 1630 - RNA, 19 nt, Homo sapiens
aagggauuuuacugcuauu

SEQ ID NO: 1631 - RNA, 19 nt, Homo sapiens
agggauuuuacugcuauug

SEQ ID NO: 1632 - RNA, 19 nt, Homo sapiens
gggauuuuacugcuauugu

SEQ ID NO: 1633 - RNA, 19 nt, Homo sapiens
ggauuuuacugcuauugua

SEQ ID NO: 1634 - RNA, 19 nt, Homo sapiens
gauuuuacugcuauuguaa

SEQ ID NO: 1635 - RNA, 19 nt, Homo sapiens
auuuuacugcuauuguaau

SEQ ID NO: 1636 - RNA, 19 nt, Homo sapiens
uuuuacugcuauuguaauc

SEQ ID NO: 1637 - RNA, 19 nt, Homo sapiens
uuuacugcuauuguaauca

SEQ ID NO: 1638 - RNA, 19 nt, Homo sapiens
uuacugcuauuguaaucag

SEQ ID NO: 1639 - RNA, 19 nt, Homo sapiens
uacugcuauuguaaucagg

SEQ ID NO: 1640 - RNA, 19 nt, Homo sapiens
acugcuauuguaaucaggc

SEQ ID NO: 1641 - RNA, 19 nt, Homo sapiens
cugcuauuguaaucaggcu

SEQ ID NO: 1642 - RNA, 19 nt, Homo sapiens
ugcuauuguaaucaggcug

SEQ ID NO: 1643 - RNA, 19 nt, Homo sapiens
gcuauuguaaucaggcugu

SEQ ID NO: 1644 - RNA, 19 nt, Homo sapiens
cuauuguaaucaggcugug

SEQ ID NO: 1645 - RNA, 19 nt, Homo sapiens
uauuguaaucaggcuguga

SEQ ID NO: 1646 - RNA, 19 nt, Homo sapiens
auuguaaucaggcugugau

SEQ ID NO: 1647 - RNA, 19 nt, Homo sapiens
uuguaaucaggcugugaug

SEQ ID NO: 1648 - RNA, 19 nt, Homo sapiens
uguaaucaggcugugaugg

SEQ ID NO: 1649 - RNA, 19 nt, Homo sapiens
guaaucaggcugugauggu

SEQ ID NO: 1650 - RNA, 19 nt, Homo sapiens
uaaucaggcugugauggua

SEQ ID NO: 1651 - RNA, 19 nt, Homo sapiens
aaucaggcugugaugguaa

SEQ ID NO: 1652 - RNA, 19 nt, Homo sapiens
aucaggcugugaugguaau

SEQ ID NO: 1653 - RNA, 19 nt, Homo sapiens
ucaggcugugaugguaaua

SEQ ID NO: 1654 - RNA, 19 nt, Homo sapiens
caggcugugaugguaauau

SEQ ID NO: 1655 - RNA, 19 nt, Homo sapiens
aggcugugaugguaauaug

SEQ ID NO: 1656 - RNA, 19 nt, Homo sapiens
ggcugugaugguaauaugg

SEQ ID NO: 1657 - RNA, 19 nt, Homo sapiens
gcugugaugguaauaugga

SEQ ID NO: 1658 - RNA, 19 nt, Homo sapiens
cugugaugguaauauggag

SEQ ID NO: 1659 - RNA, 19 nt, Homo sapiens
ugugaugguaauauggagc

SEQ ID NO: 1660 - RNA, 19 nt, Homo sapiens
gugaugguaauauggagcu

SEQ ID NO: 1661 - RNA, 19 nt, Homo sapiens
ugaugguaauauggagcug

SEQ ID NO: 1662 - RNA, 19 nt, Homo sapiens
gaugguaauauggagcuga

SEQ ID NO: 1663 - RNA, 19 nt, Homo sapiens
augguaauauggagcugag

SEQ ID NO: 1664 - RNA, 19 nt, Homo sapiens
ugguaauauggagcugagg

SEQ ID NO: 1665 - RNA, 19 nt, Homo sapiens
gguaauauggagcugagga

SEQ ID NO: 1666 - RNA, 19 nt, Homo sapiens
guaauauggagcugaggaa

SEQ ID NO: 1667 - RNA, 19 nt, Homo sapiens
uaauauggagcugaggaag

SEQ ID NO: 1668 - RNA, 19 nt, Homo sapiens
aauauggagcugaggaagc

SEQ ID NO: 1669 - RNA, 19 nt, Homo sapiens
auauggagcugaggaagcu

SEQ ID NO: 1670 - RNA, 19 nt, Homo sapiens
uauggagcugaggaagcug

SEQ ID NO: 1671 - RNA, 19 nt, Homo sapiens
auggagcugaggaagcugg

SEQ ID NO: 1672 - RNA, 19 nt, Homo sapiens
uggagcugaggaagcuggc

SEQ ID NO: 1673 - RNA, 19 nt, Homo sapiens
ggagcugaggaagcuggcu

SEQ ID NO: 1674 - RNA, 19 nt, Homo sapiens
gagcugaggaagcuggcug

SEQ ID NO: 1675 - RNA, 19 nt, Homo sapiens
agcugaggaagcuggcugg

SEQ ID NO: 1676 - RNA, 19 nt, Homo sapiens
gcugaggaagcuggcuggg

SEQ ID NO: 1677 - RNA, 19 nt, Homo sapiens
cugaggaagcuggcugggg

SEQ ID NO: 1678 - RNA, 19 nt, Homo sapiens
ugaggaagcuggcugggga

SEQ ID NO: 1679 - RNA, 19 nt, Homo sapiens
gaggaagcuggcuggggac

SEQ ID NO: 1680 - RNA, 19 nt, Homo sapiens
aggaagcuggcuggggacu

SEQ ID NO: 1681 - RNA, 19 nt, Homo sapiens
ggaagcuggcuggggacug

SEQ ID NO: 1682 - RNA, 19 nt, Homo sapiens
gaagcuggcuggggacugg

SEQ ID NO: 1683 - RNA, 19 nt, Homo sapiens
aagcuggcuggggacuggu

SEQ ID NO: 1684 - RNA, 19 nt, Homo sapiens
agcuggcuggggacugguu

SEQ ID NO: 1685 - RNA, 19 nt, Homo sapiens
gcuggcuggggacugguua

SEQ ID NO: 1686 - RNA, 19 nt, Homo sapiens
cuggcuggggacugguuau

SEQ ID NO: 1687 - RNA, 19 nt, Homo sapiens
uggcuggggacugguuaua

SEQ ID NO: 1688 - RNA, 19 nt, Homo sapiens
ggcuggggacugguuauag

SEQ ID NO: 1689 - RNA, 19 nt, Homo sapiens
gcuggggacugguuauagg

SEQ ID NO: 1690 - RNA, 19 nt, Homo sapiens
cuggggacugguuauaggu

SEQ ID NO: 1691 - RNA, 19 nt, Homo sapiens
uggggacugguuauaggug

SEQ ID NO: 1692 - RNA, 19 nt, Homo sapiens
ggggacugguuauaggugg

SEQ ID NO: 1693 - RNA, 19 nt, Homo sapiens
gggacugguuauagguggu

SEQ ID NO: 1694 - RNA, 19 nt, Homo sapiens
ggacugguuauaggugguu

SEQ ID NO: 1695 - RNA, 19 nt, Homo sapiens
gacugguuauaggugguug

SEQ ID NO: 1696 - RNA, 19 nt, Homo sapiens
acugguuauaggugguugu

SEQ ID NO: 1697 - RNA, 19 nt, Homo sapiens
cugguuauaggugguugua

SEQ ID NO: 1698 - RNA, 19 nt, Homo sapiens
ugguuauaggugguuguaa

SEQ ID NO: 1699 - RNA, 19 nt, Homo sapiens
gguuauaggugguuguaac

SEQ ID NO: 1700 - RNA, 19 nt, Homo sapiens
guuauaggugguuguaacc

SEQ ID NO: 1701 - RNA, 19 nt, Homo sapiens
uuauaggugguuguaaccc

SEQ ID NO: 1702 - RNA, 19 nt, Homo sapiens
uauaggugguuguaacccu

SEQ ID NO: 1703 - RNA, 19 nt, Homo sapiens
auaggugguuguaacccuu

SEQ ID NO: 1704 - RNA, 19 nt, Homo sapiens
uaggugguuguaacccuuu

SEQ ID NO: 1705 - RNA, 19 nt, Homo sapiens
aggugguuguaacccuuug

SEQ ID NO: 1706 - RNA, 19 nt, Homo sapiens
ggugguuguaacccuuugg

SEQ ID NO: 1707 - RNA, 19 nt, Homo sapiens
gugguuguaacccuuuggc

SEQ ID NO: 1708 - RNA, 19 nt, Homo sapiens
ugguuguaacccuuuggcc

SEQ ID NO: 1709 - RNA, 19 nt, Homo sapiens
gguuguaacccuuuggccu

SEQ ID NO: 1710 - RNA, 19 nt, Homo sapiens
guuguaacccuuuggccug

SEQ ID NO: 1711 - RNA, 19 nt, Homo sapiens
uuguaacccuuuggccugg

SEQ ID NO: 1712 - RNA, 19 nt, Homo sapiens
uguaacccuuuggccuggg

SEQ ID NO: 1713 - RNA, 19 nt, Homo sapiens
guaacccuuuggccugggu

SEQ ID NO: 1714 - RNA, 19 nt, Homo sapiens
uaacccuuuggccuggguu

SEQ ID NO: 1715 - RNA, 19 nt, Homo sapiens
aacccuuuggccuggguug

SEQ ID NO: 1716 - RNA, 19 nt, Homo sapiens
acccuuuggccuggguugg

SEQ ID NO: 1717 - RNA, 19 nt, Homo sapiens
cccuuuggccuggguugga

SEQ ID NO: 1718 - RNA, 19 nt, Homo sapiens
ccuuuggccuggguuggag

SEQ ID NO: 1719 - RNA, 19 nt, Homo sapiens
cuuuggccuggguuggagc

SEQ ID NO: 1720 - RNA, 19 nt, Homo sapiens
uuuggccuggguuggagcc

SEQ ID NO: 1721 - RNA, 19 nt, Homo sapiens
uuggccuggguuggagcca

SEQ ID NO: 1722 - RNA, 19 nt, Homo sapiens
uggccuggguuggagccag

SEQ ID NO: 1723 - RNA, 19 nt, Homo sapiens
ggccuggguuggagccagc

SEQ ID NO: 1724 - RNA, 19 nt, Homo sapiens
gccuggguuggagccagca

SEQ ID NO: 1725 - RNA, 19 nt, Homo sapiens
ccuggguuggagccagcau

SEQ ID NO: 1726 - RNA, 19 nt, Homo sapiens
cuggguuggagccagcaug

SEQ ID NO: 1727 - RNA, 19 nt, Homo sapiens
uggguuggagccagcaugc

SEQ ID NO: 1728 - RNA, 19 nt, Homo sapiens
ggguuggagccagcaugcu

SEQ ID NO: 1729 - RNA, 19 nt, Homo sapiens
gguuggagccagcaugcug

SEQ ID NO: 1730 - RNA, 19 nt, Homo sapiens
guuggagccagcaugcugc

SEQ ID NO: 1731 - RNA, 19 nt, Homo sapiens
uuggagccagcaugcugcu

SEQ ID NO: 1732 - RNA, 19 nt, Homo sapiens
uggagccagcaugcugcug

SEQ ID NO: 1733 - RNA, 19 nt, Homo sapiens
ggagccagcaugcugcugg

SEQ ID NO: 1734 - RNA, 19 nt, Homo sapiens
gagccagcaugcugcuggg

SEQ ID NO: 1735 - RNA, 19 nt, Homo sapiens
agccagcaugcugcugggg

SEQ ID NO: 1736 - RNA, 19 nt, Homo sapiens
gccagcaugcugcugggga

SEQ ID NO: 1737 - RNA, 19 nt, Homo sapiens
ccagcaugcugcuggggag

SEQ ID NO: 1738 - RNA, 19 nt, Homo sapiens
cagcaugcugcuggggaga

SEQ ID NO: 1739 - RNA, 19 nt, Homo sapiens
agcaugcugcuggggagaa

SEQ ID NO: 1740 - RNA, 19 nt, Homo sapiens
gcaugcugcuggggagaag

SEQ ID NO: 1741 - RNA, 19 nt, Homo sapiens
caugcugcuggggagaagc

SEQ ID NO: 1742 - RNA, 19 nt, Homo sapiens
augcugcuggggagaagca

SEQ ID NO: 1743 - RNA, 19 nt, Homo sapiens
ugcugcuggggagaagcag

SEQ ID NO: 1744 - RNA, 19 nt, Homo sapiens
gcugcuggggagaagcagg

SEQ ID NO: 1745 - RNA, 19 nt, Homo sapiens
cugcuggggagaagcaggg

SEQ ID NO: 1746 - RNA, 19 nt, Homo sapiens
ugcuggggagaagcaggga

SEQ ID NO: 1747 - RNA, 19 nt, Homo sapiens
gcuggggagaagcagggaa

SEQ ID NO: 1748 - RNA, 19 nt, Homo sapiens
cuggggagaagcagggaaa

SEQ ID NO: 1749 - RNA, 19 nt, Homo sapiens
uggggagaagcagggaaag

SEQ ID NO: 1750 - RNA, 19 nt, Homo sapiens
ggggagaagcagggaaagc

SEQ ID NO: 1751 - RNA, 19 nt, Homo sapiens
gggagaagcagggaaagca

SEQ ID NO: 1752 - RNA, 19 nt, Homo sapiens
ggagaagcagggaaagcag

SEQ ID NO: 1753 - RNA, 19 nt, Homo sapiens
gagaagcagggaaagcaga

SEQ ID NO: 1754 - RNA, 19 nt, Homo sapiens
agaagcagggaaagcagag

SEQ ID NO: 1755 - RNA, 19 nt, Homo sapiens
gaagcagggaaagcagagg

SEQ ID NO: 1756 - RNA, 19 nt, Homo sapiens
aagcagggaaagcagagga

SEQ ID NO: 1757 - RNA, 19 nt, Homo sapiens
agcagggaaagcagaggag

SEQ ID NO: 1758 - RNA, 19 nt, Homo sapiens
gcagggaaagcagaggagg

SEQ ID NO: 1759 - RNA, 19 nt, Homo sapiens
cagggaaagcagaggagga

SEQ ID NO: 1760 - RNA, 19 nt, Homo sapiens
agggaaagcagaggaggac

SEQ ID NO: 1761 - RNA, 19 nt, Homo sapiens
gggaaagcagaggaggaca

SEQ ID NO: 1762 - RNA, 19 nt, Homo sapiens
ggaaagcagaggaggacau

SEQ ID NO: 1763 - RNA, 19 nt, Homo sapiens
gaaagcagaggaggacaug

SEQ ID NO: 1764 - RNA, 19 nt, Homo sapiens
aaagcagaggaggacaugg

SEQ ID NO: 1765 - RNA, 19 nt, Homo sapiens
aagcagaggaggacauggu

SEQ ID NO: 1766 - RNA, 19 nt, Homo sapiens
agcagaggaggacauggug

SEQ ID NO: 1767 - RNA, 19 nt, Homo sapiens
gcagaggaggacaugguga

SEQ ID NO: 1768 - RNA, 19 nt, Homo sapiens
cagaggaggacauggugau

SEQ ID NO: 1769 - RNA, 19 nt, Homo sapiens
agaggaggacauggugaug

SEQ ID NO: 1770 - RNA, 19 nt, Homo sapiens
gaggaggacauggugaugu

SEQ ID NO: 1771 - RNA, 19 nt, Homo sapiens
aggaggacauggugaugug

SEQ ID NO: 1772 - RNA, 19 nt, Homo sapiens
ggaggacauggugauguga

SEQ ID NO: 1773 - RNA, 19 nt, Homo sapiens
gaggacauggugaugugag

SEQ ID NO: 1774 - RNA, 19 nt, Homo sapiens
aggacauggugaugugaga

SEQ ID NO: 1775 - RNA, 19 nt, Homo sapiens
ggacauggugaugugagag

SEQ ID NO: 1776 - RNA, 19 nt, Homo sapiens
gacauggugaugugagagc

SEQ ID NO: 1777 - RNA, 19 nt, Homo sapiens
acauggugaugugagagcu

SEQ ID NO: 1778 - RNA, 19 nt, Homo sapiens
cauggugaugugagagcuc

SEQ ID NO: 1779 - RNA, 19 nt, Homo sapiens
auggugaugugagagcuca

SEQ ID NO: 1780 - RNA, 19 nt, Homo sapiens
uggugaugugagagcucag

SEQ ID NO: 1781 - RNA, 19 nt, Homo sapiens
ggugaugugagagcucagu

SEQ ID NO: 1782 - RNA, 19 nt, Homo sapiens
gugaugugagagcucagug

SEQ ID NO: 1783 - RNA, 19 nt, Homo sapiens
ugaugugagagcucagugu

SEQ ID NO: 1784 - RNA, 19 nt, Homo sapiens
gaugugagagcucaguguu

SEQ ID NO: 1785 - RNA, 19 nt, Homo sapiens
augugagagcucaguguug

SEQ ID NO: 1786 - RNA, 19 nt, Homo sapiens
ugugagagcucaguguuga

SEQ ID NO: 1787 - RNA, 19 nt, Homo sapiens
gugagagcucaguguugag

SEQ ID NO: 1788 - RNA, 19 nt, Homo sapiens
ugagagcucaguguugagg

SEQ ID NO: 1789 - RNA, 19 nt, Homo sapiens
gagagcucaguguugagga

SEQ ID NO: 1790 - RNA, 19 nt, Homo sapiens
agagcucaguguugaggag

SEQ ID NO: 1791 - RNA, 19 nt, Homo sapiens
gagcucaguguugaggagg

SEQ ID NO: 1792 - RNA, 19 nt, Homo sapiens
agcucaguguugaggaggc

SEQ ID NO: 1793 - RNA, 19 nt, Homo sapiens
gcucaguguugaggaggca

SEQ ID NO: 1794 - RNA, 19 nt, Homo sapiens
cucaguguugaggaggcag

SEQ ID NO: 1795 - RNA, 19 nt, Homo sapiens
ucaguguugaggaggcaga

SEQ ID NO: 1796 - RNA, 19 nt, Homo sapiens
caguguugaggaggcagaa

SEQ ID NO: 1797 - RNA, 19 nt, Homo sapiens
aguguugaggaggcagaaa

SEQ ID NO: 1798 - RNA, 19 nt, Homo sapiens
guguugaggaggcagaaaa

SEQ ID NO: 1799 - RNA, 19 nt, Homo sapiens
uguugaggaggcagaaaau

SEQ ID NO: 1800 - RNA, 19 nt, Homo sapiens
guugaggaggcagaaaauc

SEQ ID NO: 1801 - RNA, 19 nt, Homo sapiens
uugaggaggcagaaaaucu

SEQ ID NO: 1802 - RNA, 19 nt, Homo sapiens
ugaggaggcagaaaaucuu

SEQ ID NO: 1803 - RNA, 19 nt, Homo sapiens
gaggaggcagaaaaucuuu

SEQ ID NO: 1804 - RNA, 19 nt, Homo sapiens
aggaggcagaaaaucuuug

SEQ ID NO: 1805 - RNA, 19 nt, Homo sapiens
ggaggcagaaaaucuuugc

SEQ ID NO: 1806 - RNA, 19 nt, Homo sapiens
gaggcagaaaaucuuugcu

SEQ ID NO: 1807 - RNA, 19 nt, Homo sapiens
aggcagaaaaucuuugcuc

SEQ ID NO: 1808 - RNA, 19 nt, Homo sapiens
ggcagaaaaucuuugcucu

SEQ ID NO: 1809 - RNA, 19 nt, Homo sapiens
gcagaaaaucuuugcucug

SEQ ID NO: 1810 - RNA, 19 nt, Homo sapiens
cagaaaaucuuugcucugu

SEQ ID NO: 1811 - RNA, 19 nt, Homo sapiens
agaaaaucuuugcucugua

SEQ ID NO: 1812 - RNA, 19 nt, Homo sapiens
gaaaaucuuugcucuguac

SEQ ID NO: 1813 - RNA, 19 nt, Homo sapiens
aaaaucuuugcucuguaca

SEQ ID NO: 1814 - RNA, 19 nt, Homo sapiens
aaaucuuugcucuguacac

SEQ ID NO: 1815 - RNA, 19 nt, Homo sapiens
aaucuuugcucuguacacu

SEQ ID NO: 1816 - RNA, 19 nt, Homo sapiens
aucuuugcucuguacacug

SEQ ID NO: 1817 - RNA, 19 nt, Homo sapiens
ucuuugcucuguacacugg

SEQ ID NO: 1818 - RNA, 19 nt, Homo sapiens
cuuugcucuguacacuggc

SEQ ID NO: 1819 - RNA, 19 nt, Homo sapiens
uuugcucuguacacuggcg

SEQ ID NO: 1820 - RNA, 19 nt, Homo sapiens
uugcucuguacacuggcgg

SEQ ID NO: 1821 - RNA, 19 nt, Homo sapiens
ugcucuguacacuggcggg

SEQ ID NO: 1822 - RNA, 19 nt, Homo sapiens
gcucuguacacuggcgggg

SEQ ID NO: 1823 - RNA, 19 nt, Homo sapiens
cucuguacacuggcggggc

SEQ ID NO: 1824 - RNA, 19 nt, Homo sapiens
ucuguacacuggcggggcu

SEQ ID NO: 1825 - RNA, 19 nt, Homo sapiens
cuguacacuggcggggcug

SEQ ID NO: 1826 - RNA, 19 nt, Homo sapiens
uguacacuggcggggcugg

SEQ ID NO: 1827 - RNA, 19 nt, Homo sapiens
guacacuggcggggcugga

SEQ ID NO: 1828 - RNA, 19 nt, Homo sapiens
uacacuggcggggcuggau

SEQ ID NO: 1829 - RNA, 19 nt, Homo sapiens
acacuggcggggcuggaug

SEQ ID NO: 1830 - RNA, 19 nt, Homo sapiens
cacuggcggggcuggauga

SEQ ID NO: 1831 - RNA, 19 nt, Homo sapiens
acuggcggggcuggaugau

SEQ ID NO: 1832 - RNA, 19 nt, Homo sapiens
cuggcggggcuggaugaua

SEQ ID NO: 1833 - RNA, 19 nt, Homo sapiens
uggcggggcuggaugauaa

SEQ ID NO: 1834 - RNA, 19 nt, Homo sapiens
ggcggggcuggaugauaau

SEQ ID NO: 1835 - RNA, 19 nt, Homo sapiens
gcggggcuggaugauaaug

SEQ ID NO: 1836 - RNA, 19 nt, Homo sapiens
cggggcuggaugauaaugg

SEQ ID NO: 1837 - RNA, 19 nt, Homo sapiens
ggggcuggaugauaaugga

SEQ ID NO: 1838 - RNA, 19 nt, Homo sapiens
gggcuggaugauaauggaa

SEQ ID NO: 1839 - RNA, 19 nt, Homo sapiens
ggcuggaugauaauggaag

SEQ ID NO: 1840 - RNA, 19 nt, Homo sapiens
gcuggaugauaauggaaga

SEQ ID NO: 1841 - RNA, 19 nt, Homo sapiens
cuggaugauaauggaagac

SEQ ID NO: 1842 - RNA, 19 nt, Homo sapiens
uggaugauaauggaagacu

SEQ ID NO: 1843 - RNA, 19 nt, Homo sapiens
ggaugauaauggaagacug

SEQ ID NO: 1844 - RNA, 19 nt, Homo sapiens
gaugauaauggaagacugu

SEQ ID NO: 1845 - RNA, 19 nt, Homo sapiens
augauaauggaagacuguu

SEQ ID NO: 1846 - RNA, 19 nt, Homo sapiens
ugauaauggaagacuguuu

SEQ ID NO: 1847 - RNA, 19 nt, Homo sapiens
gauaauggaagacuguuug

SEQ ID NO: 1848 - RNA, 19 nt, Homo sapiens
auaauggaagacuguuugg

SEQ ID NO: 1849 - RNA, 19 nt, Homo sapiens
uaauggaagacuguuuggu

SEQ ID NO: 1850 - RNA, 19 nt, Homo sapiens
aauggaagacuguuugguc

SEQ ID NO: 1851 - RNA, 19 nt, Homo sapiens
auggaagacuguuuggucu

SEQ ID NO: 1852 - RNA, 19 nt, Homo sapiens
uggaagacuguuuggucug

SEQ ID NO: 1853 - RNA, 19 nt, Homo sapiens
ggaagacuguuuggucugg

SEQ ID NO: 1854 - RNA, 19 nt, Homo sapiens
gaagacuguuuggucuggc

SEQ ID NO: 1855 - RNA, 19 nt, Homo sapiens
aagacuguuuggucuggcu

SEQ ID NO: 1856 - RNA, 19 nt, Homo sapiens
agacuguuuggucuggcua

SEQ ID NO: 1857 - RNA, 19 nt, Homo sapiens
gacuguuuggucuggcuag

SEQ ID NO: 1858 - RNA, 19 nt, Homo sapiens
acuguuuggucuggcuaga

SEQ ID NO: 1859 - RNA, 19 nt, Homo sapiens
cuguuuggucuggcuagag

SEQ ID NO: 1860 - RNA, 19 nt, Homo sapiens
uguuuggucuggcuagaga

SEQ ID NO: 1861 - RNA, 19 nt, Homo sapiens
guuuggucuggcuagagaa

SEQ ID NO: 1862 - RNA, 19 nt, Homo sapiens
uuuggucuggcuagagaag

SEQ ID NO: 1863 - RNA, 19 nt, Homo sapiens
uuggucuggcuagagaagc

SEQ ID NO: 1864 - RNA, 19 nt, Homo sapiens
uggucuggcuagagaagcu

SEQ ID NO: 1865 - RNA, 19 nt, Homo sapiens
ggucuggcuagagaagcug

SEQ ID NO: 1866 - RNA, 19 nt, Homo sapiens
gucuggcuagagaagcugg

SEQ ID NO: 1867 - RNA, 19 nt, Homo sapiens
ucuggcuagagaagcugga

SEQ ID NO: 1868 - RNA, 19 nt, Homo sapiens
cuggcuagagaagcuggag

SEQ ID NO: 1869 - RNA, 19 nt, Homo sapiens
uggcuagagaagcuggagg

SEQ ID NO: 1870 - RNA, 19 nt, Homo sapiens
ggcuagagaagcuggaggu

SEQ ID NO: 1871 - RNA, 19 nt, Homo sapiens
gcuagagaagcuggagguu

SEQ ID NO: 1872 - RNA, 19 nt, Homo sapiens
cuagagaagcuggagguuu

SEQ ID NO: 1873 - RNA, 19 nt, Homo sapiens
uagagaagcuggagguuuc

SEQ ID NO: 1874 - RNA, 19 nt, Homo sapiens
agagaagcuggagguuucu

SEQ ID NO: 1875 - RNA, 19 nt, Homo sapiens
gagaagcuggagguuucug

SEQ ID NO: 1876 - RNA, 19 nt, Homo sapiens
agaagcuggagguuucugg

SEQ ID NO: 1877 - RNA, 19 nt, Homo sapiens
gaagcuggagguuucuggu

SEQ ID NO: 1878 - RNA, 19 nt, Homo sapiens
aagcuggagguuucugguc

SEQ ID NO: 1879 - RNA, 19 nt, Homo sapiens
agcuggagguuucuggucc

SEQ ID NO: 1880 - RNA, 19 nt, Homo sapiens
gcuggagguuucuggucca

SEQ ID NO: 1881 - RNA, 19 nt, Homo sapiens
cuggagguuucugguccag

SEQ ID NO: 1882 - RNA, 19 nt, Homo sapiens
uggagguuucugguccagg

SEQ ID NO: 1883 - RNA, 19 nt, Homo sapiens
ggagguuucugguccagga

SEQ ID NO: 1884 - RNA, 19 nt, Homo sapiens
gagguuucugguccaggag

SEQ ID NO: 1885 - RNA, 19 nt, Homo sapiens
agguuucugguccaggagg

SEQ ID NO: 1886 - RNA, 19 nt, Homo sapiens
gguuucugguccaggaggc

SEQ ID NO: 1887 - RNA, 19 nt, Homo sapiens
guuucugguccaggaggcu

SEQ ID NO: 1888 - RNA, 19 nt, Homo sapiens
uuucugguccaggaggcug

SEQ ID NO: 1889 - RNA, 19 nt, Homo sapiens
uucugguccaggaggcugc

SEQ ID NO: 1890 - RNA, 19 nt, Homo sapiens
ucugguccaggaggcugca

SEQ ID NO: 1891 - RNA, 19 nt, Homo sapiens
cugguccaggaggcugcaa

SEQ ID NO: 1892 - RNA, 19 nt, Homo sapiens
ugguccaggaggcugcaau

SEQ ID NO: 1893 - RNA, 19 nt, Homo sapiens
gguccaggaggcugcaauc

SEQ ID NO: 1894 - RNA, 19 nt, Homo sapiens
guccaggaggcugcaaucu

SEQ ID NO: 1895 - RNA, 19 nt, Homo sapiens
uccaggaggcugcaaucug

SEQ ID NO: 1896 - RNA, 19 nt, Homo sapiens
ccaggaggcugcaaucugg

SEQ ID NO: 1897 - RNA, 19 nt, Homo sapiens
caggaggcugcaaucugga

SEQ ID NO: 1898 - RNA, 19 nt, Homo sapiens
aggaggcugcaaucuggag

SEQ ID NO: 1899 - RNA, 19 nt, Homo sapiens
ggaggcugcaaucuggagc

SEQ ID NO: 1900 - RNA, 19 nt, Homo sapiens
gaggcugcaaucuggagcc

SEQ ID NO: 1901 - RNA, 19 nt, Homo sapiens
aggcugcaaucuggagcca

SEQ ID NO: 1902 - RNA, 19 nt, Homo sapiens
ggcugcaaucuggagccac

SEQ ID NO: 1903 - RNA, 19 nt, Homo sapiens
gcugcaaucuggagccaca

SEQ ID NO: 1904 - RNA, 19 nt, Homo sapiens
cugcaaucuggagccacau

SEQ ID NO: 1905 - RNA, 19 nt, Homo sapiens
ugcaaucuggagccacaug

SEQ ID NO: 1906 - RNA, 19 nt, Homo sapiens
gcaaucuggagccacaugg

SEQ ID NO: 1907 - RNA, 19 nt, Homo sapiens
caaucuggagccacauggg

SEQ ID NO: 1908 - RNA, 19 nt, Homo sapiens
aaucuggagccacaugggu

SEQ ID NO: 1909 - RNA, 19 nt, Homo sapiens
aucuggagccacauggguu

SEQ ID NO: 1910 - RNA, 19 nt, Homo sapiens
ucuggagccacauggguuu

SEQ ID NO: 1911 - RNA, 19 nt, Homo sapiens
cuggagccacauggguuuu

SEQ ID NO: 1912 - RNA, 19 nt, Homo sapiens
uggagccacauggguuuug

SEQ ID NO: 1913 - RNA, 19 nt, Homo sapiens
ggagccacauggguuuugg

SEQ ID NO: 1914 - RNA, 19 nt, Homo sapiens
gagccacauggguuuuggg

SEQ ID NO: 1915 - RNA, 19 nt, Homo sapiens
agccacauggguuuuggga

SEQ ID NO: 1916 - RNA, 19 nt, Homo sapiens
gccacauggguuuugggac

SEQ ID NO: 1917 - RNA, 19 nt, Homo sapiens
ccacauggguuuugggacu

SEQ ID NO: 1918 - RNA, 19 nt, Homo sapiens
cacauggguuuugggacug

SEQ ID NO: 1919 - RNA, 19 nt, Homo sapiens
acauggguuuugggacugg

SEQ ID NO: 1920 - RNA, 19 nt, Homo sapiens
cauggguuuugggacugga

SEQ ID NO: 1921 - RNA, 19 nt, Homo sapiens
auggguuuugggacuggau

SEQ ID NO: 1922 - RNA, 19 nt, Homo sapiens
uggguuuugggacuggaug

SEQ ID NO: 1923 - RNA, 19 nt, Homo sapiens
ggguuuugggacuggauga

SEQ ID NO: 1924 - RNA, 19 nt, Homo sapiens
gguuuugggacuggaugaa

SEQ ID NO: 1925 - RNA, 19 nt, Homo sapiens
guuuugggacuggaugaag

SEQ ID NO: 1926 - RNA, 19 nt, Homo sapiens
uuuugggacuggaugaagu

SEQ ID NO: 1927 - RNA, 19 nt, Homo sapiens
uuugggacuggaugaagug

SEQ ID NO: 1928 - RNA, 19 nt, Homo sapiens
uugggacuggaugaagugu

SEQ ID NO: 1929 - RNA, 19 nt, Homo sapiens
ugggacuggaugaaguguu

SEQ ID NO: 1930 - RNA, 19 nt, Homo sapiens
gggacuggaugaaguguuu

SEQ ID NO: 1931 - RNA, 19 nt, Homo sapiens
ggacuggaugaaguguuuu

SEQ ID NO: 1932 - RNA, 19 nt, Homo sapiens
gacuggaugaaguguuuug

SEQ ID NO: 1933 - RNA, 19 nt, Homo sapiens
acuggaugaaguguuuugg

SEQ ID NO: 1934 - RNA, 19 nt, Homo sapiens
cuggaugaaguguuuugga

SEQ ID NO: 1935 - RNA, 19 nt, Homo sapiens
uggaugaaguguuuuggac

SEQ ID NO: 1936 - RNA, 19 nt, Homo sapiens
ggaugaaguguuuuggacg

SEQ ID NO: 1937 - RNA, 19 nt, Homo sapiens
gaugaaguguuuuggacgu

SEQ ID NO: 1938 - RNA, 19 nt, Homo sapiens
augaaguguuuuggacguu

SEQ ID NO: 1939 - RNA, 19 nt, Homo sapiens
ugaaguguuuuggacguuc

SEQ ID NO: 1940 - RNA, 19 nt, Homo sapiens
gaaguguuuuggacguucg

SEQ ID NO: 1941 - RNA, 19 nt, Homo sapiens
aaguguuuuggacguucgu

SEQ ID NO: 1942 - RNA, 19 nt, Homo sapiens
aguguuuuggacguucgua

SEQ ID NO: 1943 - RNA, 19 nt, Homo sapiens
guguuuuggacguucguag

SEQ ID NO: 1944 - RNA, 19 nt, Homo sapiens
uguuuuggacguucguagu

SEQ ID NO: 1945 - RNA, 19 nt, Homo sapiens
guuuuggacguucguaguu

SEQ ID NO: 1946 - RNA, 19 nt, Homo sapiens
uuuuggacguucguaguua

SEQ ID NO: 1947 - RNA, 19 nt, Homo sapiens
uuuggacguucguaguuaa

SEQ ID NO: 1948 - RNA, 19 nt, Homo sapiens
uuggacguucguaguuaaa

SEQ ID NO: 1949 - RNA, 19 nt, Homo sapiens
uggacguucguaguuaaac

SEQ ID NO: 1950 - RNA, 19 nt, Homo sapiens
ggacguucguaguuaaaca

SEQ ID NO: 1951 - RNA, 19 nt, Homo sapiens
gacguucguaguuaaacau

SEQ ID NO: 1952 - RNA, 19 nt, Homo sapiens
acguucguaguuaaacaug

SEQ ID NO: 1953 - RNA, 19 nt, Homo sapiens
cguucguaguuaaacaugc

SEQ ID NO: 1954 - RNA, 19 nt, Homo sapiens
guucguaguuaaacaugcu

SEQ ID NO: 1955 - RNA, 19 nt, Homo sapiens
uucguaguuaaacaugcuu

SEQ ID NO: 1956 - RNA, 19 nt, Homo sapiens
ucguaguuaaacaugcuua

SEQ ID NO: 1957 - RNA, 19 nt, Homo sapiens
cguaguuaaacaugcuuag

SEQ ID NO: 1958 - RNA, 19 nt, Homo sapiens
guaguuaaacaugcuuagu

SEQ ID NO: 1959 - RNA, 19 nt, Homo sapiens
uaguuaaacaugcuuaguu

SEQ ID NO: 1960 - RNA, 19 nt, Homo sapiens
aguuaaacaugcuuaguug

SEQ ID NO: 1961 - RNA, 19 nt, Homo sapiens
guuaaacaugcuuaguugg

SEQ ID NO: 1962 - RNA, 19 nt, Homo sapiens
uuaaacaugcuuaguuggu

SEQ ID NO: 1963 - RNA, 19 nt, Homo sapiens
uaaacaugcuuaguuggua

SEQ ID NO: 1964 - RNA, 19 nt, Homo sapiens
aaacaugcuuaguugguau

SEQ ID NO: 1965 - RNA, 19 nt, Homo sapiens
aacaugcuuaguugguaua

SEQ ID NO: 1966 - RNA, 19 nt, Homo sapiens
acaugcuuaguugguauau

SEQ ID NO: 1967 - RNA, 19 nt, Homo sapiens
caugcuuaguugguauaug

SEQ ID NO: 1968 - RNA, 19 nt, Homo sapiens
augcuuaguugguauaugg

SEQ ID NO: 1969 - RNA, 19 nt, Homo sapiens
ugcuuaguugguauaugga

SEQ ID NO: 1970 - RNA, 19 nt, Homo sapiens
gcuuaguugguauauggaa

SEQ ID NO: 1971 - RNA, 19 nt, Homo sapiens
cuuaguugguauauggaag

SEQ ID NO: 1972 - RNA, 19 nt, Homo sapiens
uuaguugguauauggaaga

SEQ ID NO: 1973 - RNA, 19 nt, Homo sapiens
uaguugguauauggaagau

SEQ ID NO: 1974 - RNA, 19 nt, Homo sapiens
aguugguauauggaagaug

SEQ ID NO: 1975 - RNA, 19 nt, Homo sapiens
guugguauauggaagauga

SEQ ID NO: 1976 - RNA, 19 nt, Homo sapiens
uugguauauggaagaugaa

SEQ ID NO: 1977 - RNA, 19 nt, Homo sapiens
ugguauauggaagaugaag

SEQ ID NO: 1978 - RNA, 19 nt, Homo sapiens
gguauauggaagaugaagg

SEQ ID NO: 1979 - RNA, 19 nt, Homo sapiens
guauauggaagaugaaggc

SEQ ID NO: 1980 - RNA, 19 nt, Homo sapiens
uauauggaagaugaaggca

SEQ ID NO: 1981 - RNA, 19 nt, Homo sapiens
auauggaagaugaaggcaa

SEQ ID NO: 1982 - RNA, 19 nt, Homo sapiens
uauggaagaugaaggcaaa

SEQ ID NO: 1983 - RNA, 19 nt, Homo sapiens
auggaagaugaaggcaaau

SEQ ID NO: 1984 - RNA, 19 nt, Homo sapiens
uggaagaugaaggcaaauu

SEQ ID NO: 1985 - RNA, 19 nt, Homo sapiens
ggaagaugaaggcaaauua

SEQ ID NO: 1986 - RNA, 19 nt, Homo sapiens
gaagaugaaggcaaauuau

SEQ ID NO: 1987 - RNA, 19 nt, Homo sapiens
aagaugaaggcaaauuauu

SEQ ID NO: 1988 - RNA, 19 nt, Homo sapiens
agaugaaggcaaauuauua

SEQ ID NO: 1989 - RNA, 19 nt, Homo sapiens
gaugaaggcaaauuauuac

SEQ ID NO: 1990 - RNA, 19 nt, Homo sapiens
augaaggcaaauuauuacu

SEQ ID NO: 1991 - RNA, 19 nt, Homo sapiens
ugaaggcaaauuauuacua

SEQ ID NO: 1992 - RNA, 19 nt, Homo sapiens
gaaggcaaauuauuacuau

SEQ ID NO: 1993 - RNA, 19 nt, Homo sapiens
aaggcaaauuauuacuaua

SEQ ID NO: 1994 - RNA, 19 nt, Homo sapiens
aggcaaauuauuacuauaa

SEQ ID NO: 1995 - RNA, 19 nt, Homo sapiens
ggcaaauuauuacuauaau

SEQ ID NO: 1996 - RNA, 19 nt, Homo sapiens
gcaaauuauuacuauaaug

SEQ ID NO: 1997 - RNA, 19 nt, Homo sapiens
caaauuauuacuauaauga

SEQ ID NO: 1998 - RNA, 19 nt, Homo sapiens
aaauuauuacuauaaugau

SEQ ID NO: 1999 - RNA, 19 nt, Homo sapiens
aauuauuacuauaaugauu

SEQ ID NO: 2000 - RNA, 19 nt, Homo sapiens
auuauuacuauaaugauuu

SEQ ID NO: 2001 - RNA, 19 nt, Homo sapiens
uuauuacuauaaugauuug

SEQ ID NO: 2002 - RNA, 19 nt, Homo sapiens
uauuacuauaaugauuugu

SEQ ID NO: 2003 - RNA, 19 nt, Homo sapiens
auuacuauaaugauuuguu

SEQ ID NO: 2004 - RNA, 19 nt, Homo sapiens
uuacuauaaugauuuguuc

SEQ ID NO: 2005 - RNA, 19 nt, Homo sapiens
uacuauaaugauuuguucc

SEQ ID NO: 2006 - RNA, 19 nt, Homo sapiens
acuauaaugauuuguuccu

SEQ ID NO: 2007 - RNA, 19 nt, Homo sapiens
cuauaaugauuuguuccug

SEQ ID NO: 2008 - RNA, 19 nt, Homo sapiens
uauaaugauuuguuccugg

SEQ ID NO: 2009 - RNA, 19 nt, Homo sapiens
auaaugauuuguuccugga

SEQ ID NO: 2010 - RNA, 19 nt, Homo sapiens
uaaugauuuguuccuggaa

SEQ ID NO: 2011 - RNA, 19 nt, Homo sapiens
aaugauuuguuccuggaag

SEQ ID NO: 2012 - RNA, 19 nt, Homo sapiens
augauuuguuccuggaagg

SEQ ID NO: 2013 - RNA, 19 nt, Homo sapiens
ugauuuguuccuggaaggg

SEQ ID NO: 2014 - RNA, 19 nt, Homo sapiens
gauuuguuccuggaagggu

SEQ ID NO: 2015 - RNA, 19 nt, Homo sapiens
auuuguuccuggaagggug

SEQ ID NO: 2016 - RNA, 19 nt, Homo sapiens
uuuguuccuggaagggugg

SEQ ID NO: 2017 - RNA, 19 nt, Homo sapiens
uuguuccuggaaggguggg

SEQ ID NO: 2018 - RNA, 19 nt, Homo sapiens
uguuccuggaagggugggg

SEQ ID NO: 2019 - RNA, 19 nt, Homo sapiens
guuccuggaaggguggggc

SEQ ID NO: 2020 - RNA, 19 nt, Homo sapiens
uuccuggaaggguggggcc

SEQ ID NO: 2021 - RNA, 19 nt, Homo sapiens
uccuggaaggguggggccc

SEQ ID NO: 2022 - RNA, 19 nt, Homo sapiens
ccuggaaggguggggcccu

SEQ ID NO: 2023 - RNA, 19 nt, Homo sapiens
cuggaaggguggggcccug

SEQ ID NO: 2024 - RNA, 19 nt, Homo sapiens
uggaaggguggggcccuga

SEQ ID NO: 2025 - RNA, 19 nt, Homo sapiens
ggaaggguggggcccugaa

SEQ ID NO: 2026 - RNA, 19 nt, Homo sapiens
gaaggguggggcccugaau

SEQ ID NO: 2027 - RNA, 19 nt, Homo sapiens
aaggguggggcccugaauu

SEQ ID NO: 2028 - RNA, 19 nt, Homo sapiens
aggguggggcccugaauuu

SEQ ID NO: 2029 - RNA, 19 nt, Homo sapiens
ggguggggcccugaauuug

SEQ ID NO: 2030 - RNA, 19 nt, Homo sapiens
gguggggcccugaauuugg

SEQ ID NO: 2031 - RNA, 19 nt, Homo sapiens
guggggcccugaauuuggg

SEQ ID NO: 2032 - RNA, 19 nt, Homo sapiens
uggggcccugaauuugggg

SEQ ID NO: 2033 - RNA, 19 nt, Homo sapiens
ggggcccugaauuuggggc

SEQ ID NO: 2034 - RNA, 19 nt, Homo sapiens
gggcccugaauuuggggcc

SEQ ID NO: 2035 - RNA, 19 nt, Homo sapiens
ggcccugaauuuggggcca

SEQ ID NO: 2036 - RNA, 19 nt, Homo sapiens
gcccugaauuuggggccac

SEQ ID NO: 2037 - RNA, 19 nt, Homo sapiens
cccugaauuuggggccaca

SEQ ID NO: 2038 - RNA, 19 nt, Homo sapiens
ccugaauuuggggccacaa

SEQ ID NO: 2039 - RNA, 19 nt, Homo sapiens
cugaauuuggggccacaag

SEQ ID NO: 2040 - RNA, 19 nt, Homo sapiens
ugaauuuggggccacaagc

SEQ ID NO: 2041 - RNA, 19 nt, Homo sapiens
gaauuuggggccacaagcc

SEQ ID NO: 2042 - RNA, 19 nt, Homo sapiens
aauuuggggccacaagccu

SEQ ID NO: 2043 - RNA, 19 nt, Homo sapiens
auuuggggccacaagccug

SEQ ID NO: 2044 - RNA, 19 nt, Homo sapiens
uuuggggccacaagccugg

SEQ ID NO: 2045 - RNA, 19 nt, Homo sapiens
uuggggccacaagccugga

SEQ ID NO: 2046 - RNA, 19 nt, Homo sapiens
uggggccacaagccuggaa

SEQ ID NO: 2047 - RNA, 19 nt, Homo sapiens
ggggccacaagccuggaau

SEQ ID NO: 2048 - RNA, 19 nt, Homo sapiens
gggccacaagccuggaauu

SEQ ID NO: 2049 - RNA, 19 nt, Homo sapiens
ggccacaagccuggaauua

SEQ ID NO: 2050 - RNA, 19 nt, Homo sapiens
gccacaagccuggaauuac

SEQ ID NO: 2051 - RNA, 19 nt, Homo sapiens
ccacaagccuggaauuacg

SEQ ID NO: 2052 - RNA, 19 nt, Homo sapiens
cacaagccuggaauuacgg

SEQ ID NO: 2053 - RNA, 19 nt, Homo sapiens
acaagccuggaauuacgga

SEQ ID NO: 2054 - RNA, 19 nt, Homo sapiens
caagccuggaauuacggaa

SEQ ID NO: 2055 - RNA, 19 nt, Homo sapiens
aagccuggaauuacggaag

SEQ ID NO: 2056 - RNA, 19 nt, Homo sapiens
agccuggaauuacggaagg

SEQ ID NO: 2057 - RNA, 19 nt, Homo sapiens
gccuggaauuacggaaggu

SEQ ID NO: 2058 - RNA, 19 nt, Homo sapiens
ccuggaauuacggaagguu

SEQ ID NO: 2059 - RNA, 19 nt, Homo sapiens
cuggaauuacggaagguug

SEQ ID NO: 2060 - RNA, 19 nt, Homo sapiens
uggaauuacggaagguugu

SEQ ID NO: 2061 - RNA, 19 nt, Homo sapiens
ggaauuacggaagguugua

SEQ ID NO: 2062 - RNA, 19 nt, Homo sapiens
gaauuacggaagguuguaa

SEQ ID NO: 2063 - RNA, 19 nt, Homo sapiens
aauuacggaagguuguaag

SEQ ID NO: 2064 - RNA, 19 nt, Homo sapiens
auuacggaagguuguaagg

SEQ ID NO: 2065 - RNA, 19 nt, Homo sapiens
uuacggaagguuguaagga

SEQ ID NO: 2066 - RNA, 19 nt, Homo sapiens
uacggaagguuguaaggaa

SEQ ID NO: 2067 - RNA, 19 nt, Homo sapiens
acggaagguuguaaggaau

SEQ ID NO: 2068 - RNA, 19 nt, Homo sapiens
cggaagguuguaaggaauc

SEQ ID NO: 2069 - RNA, 19 nt, Homo sapiens
ggaagguuguaaggaauca

SEQ ID NO: 2070 - RNA, 19 nt, Homo sapiens
gaagguuguaaggaaucag

SEQ ID NO: 2071 - RNA, 19 nt, Homo sapiens
aagguuguaaggaaucaga

SEQ ID NO: 2072 - RNA, 19 nt, Homo sapiens
agguuguaaggaaucagaa

SEQ ID NO: 2073 - RNA, 19 nt, Homo sapiens
gguuguaaggaaucagaag

SEQ ID NO: 2074 - RNA, 19 nt, Homo sapiens
guuguaaggaaucagaagc

SEQ ID NO: 2075 - RNA, 19 nt, Homo sapiens
uuguaaggaaucagaagca

SEQ ID NO: 2076 - RNA, 19 nt, Homo sapiens
uguaaggaaucagaagcaa

SEQ ID NO: 2077 - RNA, 19 nt, Homo sapiens
guaaggaaucagaagcaac

SEQ ID NO: 2078 - RNA, 19 nt, Homo sapiens
uaaggaaucagaagcaacc

SEQ ID NO: 2079 - RNA, 19 nt, Homo sapiens
aaggaaucagaagcaaccu

SEQ ID NO: 2080 - RNA, 19 nt, Homo sapiens
aggaaucagaagcaaccuu

SEQ ID NO: 2081 - RNA, 19 nt, Homo sapiens
ggaaucagaagcaaccuug

SEQ ID NO: 2082 - RNA, 19 nt, Homo sapiens
gaaucagaagcaaccuugg

SEQ ID NO: 2083 - RNA, 19 nt, Homo sapiens
aaucagaagcaaccuuggu

SEQ ID NO: 2084 - RNA, 19 nt, Homo sapiens
aucagaagcaaccuugguc

SEQ ID NO: 2085 - RNA, 19 nt, Homo sapiens
ucagaagcaaccuuggucu

SEQ ID NO: 2086 - RNA, 19 nt, Homo sapiens
cagaagcaaccuuggucug

SEQ ID NO: 2087 - RNA, 19 nt, Homo sapiens
agaagcaaccuuggucugc

SEQ ID NO: 2088 - RNA, 19 nt, Homo sapiens
gaagcaaccuuggucugcu

SEQ ID NO: 2089 - RNA, 19 nt, Homo sapiens
aagcaaccuuggucugcuc

SEQ ID NO: 2090 - RNA, 19 nt, Homo sapiens
agcaaccuuggucugcucu

SEQ ID NO: 2091 - RNA, 19 nt, Homo sapiens
gcaaccuuggucugcucuu

SEQ ID NO: 2092 - RNA, 19 nt, Homo sapiens
caaccuuggucugcucuuc

SEQ ID NO: 2093 - RNA, 19 nt, Homo sapiens
aaccuuggucugcucuucc

SEQ ID NO: 2094 - RNA, 19 nt, Homo sapiens
accuuggucugcucuuccu

SEQ ID NO: 2095 - RNA, 19 nt, Homo sapiens
ccuuggucugcucuuccuu

SEQ ID NO: 2096 - RNA, 19 nt, Homo sapiens
cuuggucugcucuuccuug

SEQ ID NO: 2097 - RNA, 19 nt, Homo sapiens
uuggucugcucuuccuugu

SEQ ID NO: 2098 - RNA, 19 nt, Homo sapiens
uggucugcucuuccuuguu

SEQ ID NO: 2099 - RNA, 19 nt, Homo sapiens
ggucugcucuuccuuguug

SEQ ID NO: 2100 - RNA, 19 nt, Homo sapiens
gucugcucuuccuuguuga

SEQ ID NO: 2101 - RNA, 19 nt, Homo sapiens
ucugcucuuccuuguugag

SEQ ID NO: 2102 - RNA, 19 nt, Homo sapiens
cugcucuuccuuguugaga

SEQ ID NO: 2103 - RNA, 19 nt, Homo sapiens
ugcucuuccuuguugagau

SEQ ID NO: 2104 - RNA, 19 nt, Homo sapiens
gcucuuccuuguugagauc

SEQ ID NO: 2105 - RNA, 19 nt, Homo sapiens
cucuuccuuguugagaucc

SEQ ID NO: 2106 - RNA, 19 nt, Homo sapiens
ucuuccuuguugagauccu

SEQ ID NO: 2107 - RNA, 19 nt, Homo sapiens
cuuccuuguugagauccug

SEQ ID NO: 2108 - RNA, 19 nt, Homo sapiens
uuccuuguugagauccuga

SEQ ID NO: 2109 - RNA, 19 nt, Homo sapiens
uccuuguugagauccugag

SEQ ID NO: 2110 - RNA, 19 nt, Homo sapiens
ccuuguugagauccugaga

SEQ ID NO: 2111 - RNA, 19 nt, Homo sapiens
cuuguugagauccugagaa

SEQ ID NO: 2112 - RNA, 19 nt, Homo sapiens
uuguugagauccugagaau

SEQ ID NO: 2113 - RNA, 19 nt, Homo sapiens
uguugagauccugagaaua

SEQ ID NO: 2114 - RNA, 19 nt, Homo sapiens
guugagauccugagaauac

SEQ ID NO: 2115 - RNA, 19 nt, Homo sapiens
uugagauccugagaauacu

SEQ ID NO: 2116 - RNA, 19 nt, Homo sapiens
ugagauccugagaauacug

SEQ ID NO: 2117 - RNA, 19 nt, Homo sapiens
gagauccugagaauacugu

SEQ ID NO: 2118 - RNA, 19 nt, Homo sapiens
agauccugagaauacugug

SEQ ID NO: 2119 - RNA, 19 nt, Homo sapiens
gauccugagaauacugugc

SEQ ID NO: 2120 - RNA, 19 nt, Homo sapiens
auccugagaauacugugcu

SEQ ID NO: 2121 - RNA, 19 nt, Homo sapiens
uccugagaauacugugcuc

SEQ ID NO: 2122 - RNA, 19 nt, Homo sapiens
ccugagaauacugugcucc

SEQ ID NO: 2123 - RNA, 19 nt, Homo sapiens
cugagaauacugugcuccu

SEQ ID NO: 2124 - RNA, 19 nt, Homo sapiens
ugagaauacugugcuccug

SEQ ID NO: 2125 - RNA, 19 nt, Homo sapiens
gagaauacugugcuccugg

SEQ ID NO: 2126 - RNA, 19 nt, Homo sapiens
agaauacugugcuccuggc

SEQ ID NO: 2127 - RNA, 19 nt, Homo sapiens
gaauacugugcuccuggcu

SEQ ID NO: 2128 - RNA, 19 nt, Homo sapiens
aauacugugcuccuggcuu

SEQ ID NO: 2129 - RNA, 19 nt, Homo sapiens
auacugugcuccuggcuuu

SEQ ID NO: 2130 - RNA, 19 nt, Homo sapiens
uacugugcuccuggcuuug

SEQ ID NO: 2131 - RNA, 19 nt, Homo sapiens
acugugcuccuggcuuugg

SEQ ID NO: 2132 - RNA, 19 nt, Homo sapiens
cugugcuccuggcuuuggu

SEQ ID NO: 2133 - RNA, 19 nt, Homo sapiens
ugugcuccuggcuuuggua

SEQ ID NO: 2134 - RNA, 19 nt, Homo sapiens
gugcuccuggcuuugguag

SEQ ID NO: 2135 - RNA, 19 nt, Homo sapiens
ugcuccuggcuuugguaga

SEQ ID NO: 2136 - RNA, 19 nt, Homo sapiens
gcuccuggcuuugguagag

SEQ ID NO: 2137 - RNA, 19 nt, Homo sapiens
cuccuggcuuugguagagu

SEQ ID NO: 2138 - RNA, 19 nt, Homo sapiens
uccuggcuuugguagagug

SEQ ID NO: 2139 - RNA, 19 nt, Homo sapiens
ccuggcuuugguagaguga

SEQ ID NO: 2140 - RNA, 19 nt, Homo sapiens
cuggcuuugguagagugac

SEQ ID NO: 2141 - RNA, 19 nt, Homo sapiens
uggcuuugguagagugacc

SEQ ID NO: 2142 - RNA, 19 nt, Homo sapiens
ggcuuugguagagugaccu

SEQ ID NO: 2143 - RNA, 19 nt, Homo sapiens
gcuuugguagagugaccuu

SEQ ID NO: 2144 - RNA, 19 nt, Homo sapiens
cuuugguagagugaccuuc

SEQ ID NO: 2145 - RNA, 19 nt, Homo sapiens
uuugguagagugaccuucu

SEQ ID NO: 2146 - RNA, 19 nt, Homo sapiens
uugguagagugaccuucuc

SEQ ID NO: 2147 - RNA, 19 nt, Homo sapiens
ugguagagugaccuucucu

SEQ ID NO: 2148 - RNA, 19 nt, Homo sapiens
gguagagugaccuucucuu

SEQ ID NO: 2149 - RNA, 19 nt, Homo sapiens
guagagugaccuucucuug

SEQ ID NO: 2150 - RNA, 19 nt, Homo sapiens
uagagugaccuucucuuga

SEQ ID NO: 2151 - RNA, 19 nt, Homo sapiens
agagugaccuucucuugaa

SEQ ID NO: 2152 - RNA, 19 nt, Homo sapiens
gagugaccuucucuugaag

SEQ ID NO: 2153 - RNA, 19 nt, Homo sapiens
agugaccuucucuugaaga

SEQ ID NO: 2154 - RNA, 19 nt, Homo sapiens
gugaccuucucuugaagaa

SEQ ID NO: 2155 - RNA, 19 nt, Homo sapiens
ugaccuucucuugaagaau

SEQ ID NO: 2156 - RNA, 19 nt, Homo sapiens
gaccuucucuugaagaaua

SEQ ID NO: 2157 - RNA, 19 nt, Homo sapiens
accuucucuugaagaauau

SEQ ID NO: 2158 - RNA, 19 nt, Homo sapiens
ccuucucuugaagaauauu

SEQ ID NO: 2159 - RNA, 19 nt, Homo sapiens
cuucucuugaagaauauug

SEQ ID NO: 2160 - RNA, 19 nt, Homo sapiens
uucucuugaagaauauugu

SEQ ID NO: 2161 - RNA, 19 nt, Homo sapiens
ucucuugaagaauauuguu

SEQ ID NO: 2162 - RNA, 19 nt, Homo sapiens
cucuugaagaauauuguuc

SEQ ID NO: 2163 - RNA, 19 nt, Homo sapiens
ucuugaagaauauuguucc

SEQ ID NO: 2164 - RNA, 19 nt, Homo sapiens
cuugaagaauauuguuccc

SEQ ID NO: 2165 - RNA, 19 nt, Homo sapiens
uugaagaauauuguucccg

SEQ ID NO: 2166 - RNA, 19 nt, Homo sapiens
ugaagaauauuguucccgu

SEQ ID NO: 2167 - RNA, 19 nt, Homo sapiens
gaagaauauuguucccgua

SEQ ID NO: 2168 - RNA, 19 nt, Homo sapiens
aagaauauuguucccguag

SEQ ID NO: 2169 - RNA, 19 nt, Homo sapiens
agaauauuguucccguagu

SEQ ID NO: 2170 - RNA, 19 nt, Homo sapiens
gaauauuguucccguaguu

SEQ ID NO: 2171 - RNA, 19 nt, Homo sapiens
aauauuguucccguaguuc

SEQ ID NO: 2172 - RNA, 19 nt, Homo sapiens
auauuguucccguaguucc

SEQ ID NO: 2173 - RNA, 19 nt, Homo sapiens
uauuguucccguaguucca

SEQ ID NO: 2174 - RNA, 19 nt, Homo sapiens
auuguucccguaguuccag

SEQ ID NO: 2175 - RNA, 19 nt, Homo sapiens
uuguucccguaguuccaga

SEQ ID NO: 2176 - RNA, 19 nt, Homo sapiens
uguucccguaguuccagag

SEQ ID NO: 2177 - RNA, 19 nt, Homo sapiens
guucccguaguuccagagg

SEQ ID NO: 2178 - RNA, 19 nt, Homo sapiens
uucccguaguuccagaggg

SEQ ID NO: 2179 - RNA, 19 nt, Homo sapiens
ucccguaguuccagagggu

SEQ ID NO: 2180 - RNA, 19 nt, Homo sapiens
cccguaguuccagagggug

SEQ ID NO: 2181 - RNA, 19 nt, Homo sapiens
ccguaguuccagagggugc

SEQ ID NO: 2182 - RNA, 19 nt, Homo sapiens
cguaguuccagagggugcc

SEQ ID NO: 2183 - RNA, 19 nt, Homo sapiens
guaguuccagagggugcca

SEQ ID NO: 2184 - RNA, 19 nt, Homo sapiens
uaguuccagagggugccag

SEQ ID NO: 2185 - RNA, 19 nt, Homo sapiens
aguuccagagggugccagc

SEQ ID NO: 2186 - RNA, 19 nt, Homo sapiens
guuccagagggugccagcu

SEQ ID NO: 2187 - RNA, 19 nt, Homo sapiens
uuccagagggugccagcug

SEQ ID NO: 2188 - RNA, 19 nt, Homo sapiens
uccagagggugccagcugg

SEQ ID NO: 2189 - RNA, 19 nt, Homo sapiens
ccagagggugccagcuggg

SEQ ID NO: 2190 - RNA, 19 nt, Homo sapiens
cagagggugccagcugggu

SEQ ID NO: 2191 - RNA, 19 nt, Homo sapiens
agagggugccagcuggguu

SEQ ID NO: 2192 - RNA, 19 nt, Homo sapiens
gagggugccagcuggguuu

SEQ ID NO: 2193 - RNA, 19 nt, Homo sapiens
agggugccagcuggguuua

SEQ ID NO: 2194 - RNA, 19 nt, Homo sapiens
gggugccagcuggguuuaa

SEQ ID NO: 2195 - RNA, 19 nt, Homo sapiens
ggugccagcuggguuuaac

SEQ ID NO: 2196 - RNA, 19 nt, Homo sapiens
gugccagcuggguuuaacc

SEQ ID NO: 2197 - RNA, 19 nt, Homo sapiens
ugccagcuggguuuaaccc

SEQ ID NO: 2198 - RNA, 19 nt, Homo sapiens
gccagcuggguuuaaccca

SEQ ID NO: 2199 - RNA, 19 nt, Homo sapiens
ccagcuggguuuaacccac

SEQ ID NO: 2200 - RNA, 19 nt, Homo sapiens
cagcuggguuuaacccacu

SEQ ID NO: 2201 - RNA, 19 nt, Homo sapiens
agcuggguuuaacccacua

SEQ ID NO: 2202 - RNA, 19 nt, Homo sapiens
gcuggguuuaacccacuau

SEQ ID NO: 2203 - RNA, 19 nt, Homo sapiens
cuggguuuaacccacuauu

SEQ ID NO: 2204 - RNA, 19 nt, Homo sapiens
uggguuuaacccacuauug

SEQ ID NO: 2205 - RNA, 19 nt, Homo sapiens
ggguuuaacccacuauuga

SEQ ID NO: 2206 - RNA, 19 nt, Homo sapiens
gguuuaacccacuauugaa

SEQ ID NO: 2207 - RNA, 19 nt, Homo sapiens
guuuaacccacuauugaag

SEQ ID NO: 2208 - RNA, 19 nt, Homo sapiens
uuuaacccacuauugaagg

SEQ ID NO: 2209 - RNA, 19 nt, Homo sapiens
uuaacccacuauugaaggg

SEQ ID NO: 2210 - RNA, 19 nt, Homo sapiens
uaacccacuauugaaggga

SEQ ID NO: 2211 - RNA, 19 nt, Homo sapiens
aacccacuauugaagggaa

SEQ ID NO: 2212 - RNA, 19 nt, Homo sapiens
acccacuauugaagggaag

SEQ ID NO: 2213 - RNA, 19 nt, Homo sapiens
cccacuauugaagggaagg

SEQ ID NO: 2214 - RNA, 19 nt, Homo sapiens
ccacuauugaagggaagga

SEQ ID NO: 2215 - RNA, 19 nt, Homo sapiens
cacuauugaagggaaggaa

SEQ ID NO: 2216 - RNA, 19 nt, Homo sapiens
acuauugaagggaaggaag

SEQ ID NO: 2217 - RNA, 19 nt, Homo sapiens
cuauugaagggaaggaaga

SEQ ID NO: 2218 - RNA, 19 nt, Homo sapiens
uauugaagggaaggaagag

SEQ ID NO: 2219 - RNA, 19 nt, Homo sapiens
auugaagggaaggaagagg

SEQ ID NO: 2220 - RNA, 19 nt, Homo sapiens
uugaagggaaggaagaggc

SEQ ID NO: 2221 - RNA, 19 nt, Homo sapiens
ugaagggaaggaagaggca

SEQ ID NO: 2222 - RNA, 19 nt, Homo sapiens
gaagggaaggaagaggcau

SEQ ID NO: 2223 - RNA, 19 nt, Homo sapiens
aagggaaggaagaggcauc

SEQ ID NO: 2224 - RNA, 19 nt, Homo sapiens
agggaaggaagaggcaucu

SEQ ID NO: 2225 - RNA, 19 nt, Homo sapiens
gggaaggaagaggcaucuc

SEQ ID NO: 2226 - RNA, 19 nt, Homo sapiens
ggaaggaagaggcaucucc

SEQ ID NO: 2227 - RNA, 19 nt, Homo sapiens
gaaggaagaggcaucuccu

SEQ ID NO: 2228 - RNA, 19 nt, Homo sapiens
aaggaagaggcaucuccuu

SEQ ID NO: 2229 - RNA, 19 nt, Homo sapiens
aggaagaggcaucuccuuc

SEQ ID NO: 2230 - RNA, 19 nt, Homo sapiens
ggaagaggcaucuccuucc

SEQ ID NO: 2231 - RNA, 19 nt, Homo sapiens
gaagaggcaucuccuuccc

SEQ ID NO: 2232 - RNA, 19 nt, Homo sapiens
aagaggcaucuccuucccu

SEQ ID NO: 2233 - RNA, 19 nt, Homo sapiens
agaggcaucuccuucccuc

SEQ ID NO: 2234 - RNA, 19 nt, Homo sapiens
gaggcaucuccuucccuca

SEQ ID NO: 2235 - RNA, 19 nt, Homo sapiens
aggcaucuccuucccucac

SEQ ID NO: 2236 - RNA, 19 nt, Homo sapiens
ggcaucuccuucccucaca

SEQ ID NO: 2237 - RNA, 19 nt, Homo sapiens
gcaucuccuucccucacag

SEQ ID NO: 2238 - RNA, 19 nt, Homo sapiens
caucuccuucccucacaga

SEQ ID NO: 2239 - RNA, 19 nt, Homo sapiens
aucuccuucccucacagac

SEQ ID NO: 2240 - RNA, 19 nt, Homo sapiens
ucuccuucccucacagacu

SEQ ID NO: 2241 - RNA, 19 nt, Homo sapiens
cuccuucccucacagacua

SEQ ID NO: 2242 - RNA, 19 nt, Homo sapiens
uccuucccucacagacuaa

SEQ ID NO: 2243 - RNA, 19 nt, Homo sapiens
ccuucccucacagacuaau

SEQ ID NO: 2244 - RNA, 19 nt, Homo sapiens
cuucccucacagacuaauc

SEQ ID NO: 2245 - RNA, 19 nt, Homo sapiens
uucccucacagacuaaucu

SEQ ID NO: 2246 - RNA, 19 nt, Homo sapiens
ucccucacagacuaaucua

SEQ ID NO: 2247 - RNA, 19 nt, Homo sapiens
cccucacagacuaaucuag

SEQ ID NO: 2248 - RNA, 19 nt, Homo sapiens
ccucacagacuaaucuagu

SEQ ID NO: 2249 - RNA, 19 nt, Homo sapiens
cucacagacuaaucuagug

SEQ ID NO: 2250 - RNA, 19 nt, Homo sapiens
ucacagacuaaucuagugg

SEQ ID NO: 2251 - RNA, 19 nt, Homo sapiens
cacagacuaaucuaguggc

SEQ ID NO: 2252 - RNA, 19 nt, Homo sapiens
acagacuaaucuaguggcu

SEQ ID NO: 2253 - RNA, 19 nt, Homo sapiens
cagacuaaucuaguggcuc

SEQ ID NO: 2254 - RNA, 19 nt, Homo sapiens
agacuaaucuaguggcucu

SEQ ID NO: 2255 - RNA, 19 nt, Homo sapiens
gacuaaucuaguggcucug

SEQ ID NO: 2256 - RNA, 19 nt, Homo sapiens
acuaaucuaguggcucugu

SEQ ID NO: 2257 - RNA, 19 nt, Homo sapiens
cuaaucuaguggcucugug

SEQ ID NO: 2258 - RNA, 19 nt, Homo sapiens
uaaucuaguggcucugugc

SEQ ID NO: 2259 - RNA, 19 nt, Homo sapiens
aaucuaguggcucugugcu

SEQ ID NO: 2260 - RNA, 19 nt, Homo sapiens
aucuaguggcucugugcuu

SEQ ID NO: 2261 - RNA, 20 nt, Homo sapiens
uccguuuuaaauauuugaau

SEQ ID NO: 2262 - RNA, 20 nt, Homo sapiens
ccguuuuaaauauuugaauu

SEQ ID NO: 2263 - RNA, 20 nt, Homo sapiens
cguuuuaaauauuugaauuu

SEQ ID NO: 2264 - RNA, 20 nt, Homo sapiens
guuuuaaauauuugaauuuu

SEQ ID NO: 2265 - RNA, 20 nt, Homo sapiens
uuuuaaauauuugaauuuua

SEQ ID NO: 2266 - RNA, 20 nt, Homo sapiens
uuuaaauauuugaauuuuau

SEQ ID NO: 2267 - RNA, 20 nt, Homo sapiens
uuaaauauuugaauuuuauu

SEQ ID NO: 2268 - RNA, 20 nt, Homo sapiens
uaaauauuugaauuuuauuu

SEQ ID NO: 2269 - RNA, 20 nt, Homo sapiens
aaauauuugaauuuuauuuu

SEQ ID NO: 2270 - RNA, 20 nt, Homo sapiens
aauauuugaauuuuauuuuc

SEQ ID NO: 2271 - RNA, 20 nt, Homo sapiens
auauuugaauuuuauuuucu

SEQ ID NO: 2272 - RNA, 20 nt, Homo sapiens
uauuugaauuuuauuuucuu

SEQ ID NO: 2273 - RNA, 20 nt, Homo sapiens
auuugaauuuuauuuucuuu

SEQ ID NO: 2274 - RNA, 20 nt, Homo sapiens
uuugaauuuuauuuucuuuu

SEQ ID NO: 2275 - RNA, 20 nt, Homo sapiens
uugaauuuuauuuucuuuug

SEQ ID NO: 2276 - RNA, 20 nt, Homo sapiens
ugaauuuuauuuucuuuuga

SEQ ID NO: 2277 - RNA, 20 nt, Homo sapiens
gaauuuuauuuucuuuugac

SEQ ID NO: 2278 - RNA, 20 nt, Homo sapiens
aauuuuauuuucuuuugaca

SEQ ID NO: 2279 - RNA, 20 nt, Homo sapiens
auuuuauuuucuuuugacau

SEQ ID NO: 2280 - RNA, 20 nt, Homo sapiens
uuuuauuuucuuuugacaua

SEQ ID NO: 2281 - RNA, 20 nt, Homo sapiens
uuuauuuucuuuugacauac

SEQ ID NO: 2282 - RNA, 20 nt, Homo sapiens
uuauuuucuuuugacauaca

SEQ ID NO: 2283 - RNA, 20 nt, Homo sapiens
uauuuucuuuugacauacaa

SEQ ID NO: 2284 - RNA, 20 nt, Homo sapiens
auuuucuuuugacauacaac

SEQ ID NO: 2285 - RNA, 20 nt, Homo sapiens
uuuucuuuugacauacaacu

SEQ ID NO: 2286 - RNA, 20 nt, Homo sapiens
uuucuuuugacauacaacug

SEQ ID NO: 2287 - RNA, 20 nt, Homo sapiens
uucuuuugacauacaacugu

SEQ ID NO: 2288 - RNA, 20 nt, Homo sapiens
ucuuuugacauacaacugug

SEQ ID NO: 2289 - RNA, 20 nt, Homo sapiens
cuuuugacauacaacugugg

SEQ ID NO: 2290 - RNA, 20 nt, Homo sapiens
uuuugacauacaacugugga

SEQ ID NO: 2291 - RNA, 20 nt, Homo sapiens
uuugacauacaacuguggaa

SEQ ID NO: 2292 - RNA, 20 nt, Homo sapiens
uugacauacaacuguggaac

SEQ ID NO: 2293 - RNA, 20 nt, Homo sapiens
ugacauacaacuguggaaca

SEQ ID NO: 2294 - RNA, 20 nt, Homo sapiens
gacauacaacuguggaacac

SEQ ID NO: 2295 - RNA, 20 nt, Homo sapiens
acauacaacuguggaacacu

SEQ ID NO: 2296 - RNA, 20 nt, Homo sapiens
cauacaacuguggaacacuc

SEQ ID NO: 2297 - RNA, 20 nt, Homo sapiens
auacaacuguggaacacuca

SEQ ID NO: 2298 - RNA, 20 nt, Homo sapiens
uacaacuguggaacacucag

SEQ ID NO: 2299 - RNA, 20 nt, Homo sapiens
acaacuguggaacacucaga

SEQ ID NO: 2300 - RNA, 20 nt, Homo sapiens
caacuguggaacacucagau

SEQ ID NO: 2301 - RNA, 20 nt, Homo sapiens
aacuguggaacacucagaua

SEQ ID NO: 2302 - RNA, 20 nt, Homo sapiens
acuguggaacacucagauaa

SEQ ID NO: 2303 - RNA, 20 nt, Homo sapiens
cuguggaacacucagauaau

SEQ ID NO: 2304 - RNA, 20 nt, Homo sapiens
uguggaacacucagauaauc

SEQ ID NO: 2305 - RNA, 20 nt, Homo sapiens
guggaacacucagauaaucu

SEQ ID NO: 2306 - RNA, 20 nt, Homo sapiens
uggaacacucagauaaucua

SEQ ID NO: 2307 - RNA, 20 nt, Homo sapiens
ggaacacucagauaaucuau

SEQ ID NO: 2308 - RNA, 20 nt, Homo sapiens
gaacacucagauaaucuaua

SEQ ID NO: 2309 - RNA, 20 nt, Homo sapiens
aacacucagauaaucuauac

SEQ ID NO: 2310 - RNA, 20 nt, Homo sapiens
acacucagauaaucuauacc

SEQ ID NO: 2311 - RNA, 20 nt, Homo sapiens
cacucagauaaucuauacca

SEQ ID NO: 2312 - RNA, 20 nt, Homo sapiens
acucagauaaucuauaccau

SEQ ID NO: 2313 - RNA, 20 nt, Homo sapiens
cucagauaaucuauaccaug

SEQ ID NO: 2314 - RNA, 20 nt, Homo sapiens
ucagauaaucuauaccaugu

SEQ ID NO: 2315 - RNA, 20 nt, Homo sapiens
cagauaaucuauaccauguu

SEQ ID NO: 2316 - RNA, 20 nt, Homo sapiens
agauaaucuauaccauguua

SEQ ID NO: 2317 - RNA, 20 nt, Homo sapiens
gauaaucuauaccauguuag

SEQ ID NO: 2318 - RNA, 20 nt, Homo sapiens
auaaucuauaccauguuagu

SEQ ID NO: 2319 - RNA, 20 nt, Homo sapiens
uaaucuauaccauguuagua

SEQ ID NO: 2320 - RNA, 20 nt, Homo sapiens
aaucuauaccauguuaguau

SEQ ID NO: 2321 - RNA, 20 nt, Homo sapiens
aucuauaccauguuaguauu

SEQ ID NO: 2322 - RNA, 20 nt, Homo sapiens
ucuauaccauguuaguauuc

SEQ ID NO: 2323 - RNA, 20 nt, Homo sapiens
cuauaccauguuaguauucc

SEQ ID NO: 2324 - RNA, 20 nt, Homo sapiens
uauaccauguuaguauuccu

SEQ ID NO: 2325 - RNA, 20 nt, Homo sapiens
auaccauguuaguauuccua

SEQ ID NO: 2326 - RNA, 20 nt, Homo sapiens
uaccauguuaguauuccuac

SEQ ID NO: 2327 - RNA, 20 nt, Homo sapiens
accauguuaguauuccuaca

SEQ ID NO: 2328 - RNA, 20 nt, Homo sapiens
ccauguuaguauuccuacaa

SEQ ID NO: 2329 - RNA, 20 nt, Homo sapiens
cauguuaguauuccuacaag

SEQ ID NO: 2330 - RNA, 20 nt, Homo sapiens
auguuaguauuccuacaaga

SEQ ID NO: 2331 - RNA, 20 nt, Homo sapiens
uguuaguauuccuacaagag

SEQ ID NO: 2332 - RNA, 20 nt, Homo sapiens
guuaguauuccuacaagaga

SEQ ID NO: 2333 - RNA, 20 nt, Homo sapiens
uuaguauuccuacaagagaa

SEQ ID NO: 2334 - RNA, 20 nt, Homo sapiens
uaguauuccuacaagagaaa

SEQ ID NO: 2335 - RNA, 20 nt, Homo sapiens
aguauuccuacaagagaaaa

SEQ ID NO: 2336 - RNA, 20 nt, Homo sapiens
guauuccuacaagagaaaac

SEQ ID NO: 2337 - RNA, 20 nt, Homo sapiens
uauuccuacaagagaaaacg

SEQ ID NO: 2338 - RNA, 20 nt, Homo sapiens
auuccuacaagagaaaacgg

SEQ ID NO: 2339 - RNA, 20 nt, Homo sapiens
uuccuacaagagaaaacggg

SEQ ID NO: 2340 - RNA, 20 nt, Homo sapiens
uccuacaagagaaaacgggu

SEQ ID NO: 2341 - RNA, 20 nt, Homo sapiens
ccuacaagagaaaacgggua

SEQ ID NO: 2342 - RNA, 20 nt, Homo sapiens
cuacaagagaaaacggguaa

SEQ ID NO: 2343 - RNA, 20 nt, Homo sapiens
uacaagagaaaacggguaaa

SEQ ID NO: 2344 - RNA, 20 nt, Homo sapiens
acaagagaaaacggguaaaa

SEQ ID NO: 2345 - RNA, 20 nt, Homo sapiens
caagagaaaacggguaaaac

SEQ ID NO: 2346 - RNA, 20 nt, Homo sapiens
aagagaaaacggguaaaaca

SEQ ID NO: 2347 - RNA, 20 nt, Homo sapiens
agagaaaacggguaaaacag

SEQ ID NO: 2348 - RNA, 20 nt, Homo sapiens
gagaaaacggguaaaacagu

SEQ ID NO: 2349 - RNA, 20 nt, Homo sapiens
agaaaacggguaaaacagua

SEQ ID NO: 2350 - RNA, 20 nt, Homo sapiens
gaaaacggguaaaacaguau

SEQ ID NO: 2351 - RNA, 20 nt, Homo sapiens
aaaacggguaaaacaguauu

SEQ ID NO: 2352 - RNA, 20 nt, Homo sapiens
aaacggguaaaacaguauuu

SEQ ID NO: 2353 - RNA, 20 nt, Homo sapiens
aacggguaaaacaguauuua

SEQ ID NO: 2354 - RNA, 20 nt, Homo sapiens
acggguaaaacaguauuuag

SEQ ID NO: 2355 - RNA, 20 nt, Homo sapiens
cggguaaaacaguauuuaga

SEQ ID NO: 2356 - RNA, 20 nt, Homo sapiens
ggguaaaacaguauuuagaa

SEQ ID NO: 2357 - RNA, 20 nt, Homo sapiens
gguaaaacaguauuuagaaa

SEQ ID NO: 2358 - RNA, 20 nt, Homo sapiens
guaaaacaguauuuagaaag

SEQ ID NO: 2359 - RNA, 20 nt, Homo sapiens
uaaaacaguauuuagaaagc

SEQ ID NO: 2360 - RNA, 20 nt, Homo sapiens
aaaacaguauuuagaaagca

SEQ ID NO: 2361 - RNA, 20 nt, Homo sapiens
aaacaguauuuagaaagcag

SEQ ID NO: 2362 - RNA, 20 nt, Homo sapiens
aacaguauuuagaaagcagu

SEQ ID NO: 2363 - RNA, 20 nt, Homo sapiens
acaguauuuagaaagcagua

SEQ ID NO: 2364 - RNA, 20 nt, Homo sapiens
caguauuuagaaagcaguac

SEQ ID NO: 2365 - RNA, 20 nt, Homo sapiens
aguauuuagaaagcaguacc

SEQ ID NO: 2366 - RNA, 20 nt, Homo sapiens
guauuuagaaagcaguacca

SEQ ID NO: 2367 - RNA, 20 nt, Homo sapiens
uauuuagaaagcaguaccag

SEQ ID NO: 2368 - RNA, 20 nt, Homo sapiens
auuuagaaagcaguaccagu

SEQ ID NO: 2369 - RNA, 20 nt, Homo sapiens
uuuagaaagcaguaccagua

SEQ ID NO: 2370 - RNA, 20 nt, Homo sapiens
uuagaaagcaguaccaguaa

SEQ ID NO: 2371 - RNA, 20 nt, Homo sapiens
uagaaagcaguaccaguaaa

SEQ ID NO: 2372 - RNA, 20 nt, Homo sapiens
agaaagcaguaccaguaaac

SEQ ID NO: 2373 - RNA, 20 nt, Homo sapiens
gaaagcaguaccaguaaacg

SEQ ID NO: 2374 - RNA, 20 nt, Homo sapiens
aaagcaguaccaguaaacgu

SEQ ID NO: 2375 - RNA, 20 nt, Homo sapiens
aagcaguaccaguaaacguu

SEQ ID NO: 2376 - RNA, 20 nt, Homo sapiens
agcaguaccaguaaacguua

SEQ ID NO: 2377 - RNA, 20 nt, Homo sapiens
gcaguaccaguaaacguuau

SEQ ID NO: 2378 - RNA, 20 nt, Homo sapiens
caguaccaguaaacguuauu

SEQ ID NO: 2379 - RNA, 20 nt, Homo sapiens
aguaccaguaaacguuauua

SEQ ID NO: 2380 - RNA, 20 nt, Homo sapiens
guaccaguaaacguuauuac

SEQ ID NO: 2381 - RNA, 20 nt, Homo sapiens
uaccaguaaacguuauuaca

SEQ ID NO: 2382 - RNA, 20 nt, Homo sapiens
accaguaaacguuauuacaa

SEQ ID NO: 2383 - RNA, 20 nt, Homo sapiens
ccaguaaacguuauuacaag

SEQ ID NO: 2384 - RNA, 20 nt, Homo sapiens
caguaaacguuauuacaagc

SEQ ID NO: 2385 - RNA, 20 nt, Homo sapiens
aguaaacguuauuacaagca

SEQ ID NO: 2386 - RNA, 20 nt, Homo sapiens
guaaacguuauuacaagcau

SEQ ID NO: 2387 - RNA, 20 nt, Homo sapiens
uaaacguuauuacaagcauu

SEQ ID NO: 2388 - RNA, 20 nt, Homo sapiens
aaacguuauuacaagcauua

SEQ ID NO: 2389 - RNA, 20 nt, Homo sapiens
aacguuauuacaagcauuag

SEQ ID NO: 2390 - RNA, 20 nt, Homo sapiens
acguuauuacaagcauuaga

SEQ ID NO: 2391 - RNA, 20 nt, Homo sapiens
cguuauuacaagcauuagau

SEQ ID NO: 2392 - RNA, 20 nt, Homo sapiens
guuauuacaagcauuagaug

SEQ ID NO: 2393 - RNA, 20 nt, Homo sapiens
uuauuacaagcauuagaugu

SEQ ID NO: 2394 - RNA, 20 nt, Homo sapiens
uauuacaagcauuagaugug

SEQ ID NO: 2395 - RNA, 20 nt, Homo sapiens
auuacaagcauuagaugugu

SEQ ID NO: 2396 - RNA, 20 nt, Homo sapiens
uuacaagcauuagauguguu

SEQ ID NO: 2397 - RNA, 20 nt, Homo sapiens
uacaagcauuagauguguuu

SEQ ID NO: 2398 - RNA, 20 nt, Homo sapiens
acaagcauuagauguguuua

SEQ ID NO: 2399 - RNA, 20 nt, Homo sapiens
caagcauuagauguguuuaa

SEQ ID NO: 2400 - RNA, 20 nt, Homo sapiens
aagcauuagauguguuuaaa

SEQ ID NO: 2401 - RNA, 20 nt, Homo sapiens
agcauuagauguguuuaaaa

SEQ ID NO: 2402 - RNA, 20 nt, Homo sapiens
gcauuagauguguuuaaaaa

SEQ ID NO: 2403 - RNA, 20 nt, Homo sapiens
cauuagauguguuuaaaaag

SEQ ID NO: 2404 - RNA, 20 nt, Homo sapiens
auuagauguguuuaaaaagu

SEQ ID NO: 2405 - RNA, 20 nt, Homo sapiens
uuagauguguuuaaaaaguu

SEQ ID NO: 2406 - RNA, 20 nt, Homo sapiens
uagauguguuuaaaaaguug

SEQ ID NO: 2407 - RNA, 20 nt, Homo sapiens
agauguguuuaaaaaguuga

SEQ ID NO: 2408 - RNA, 20 nt, Homo sapiens
gauguguuuaaaaaguugau

SEQ ID NO: 2409 - RNA, 20 nt, Homo sapiens
auguguuuaaaaaguugaua

SEQ ID NO: 2410 - RNA, 20 nt, Homo sapiens
uguguuuaaaaaguugauac

SEQ ID NO: 2411 - RNA, 20 nt, Homo sapiens
guguuuaaaaaguugauacu

SEQ ID NO: 2412 - RNA, 20 nt, Homo sapiens
uguuuaaaaaguugauacua

SEQ ID NO: 2413 - RNA, 20 nt, Homo sapiens
guuuaaaaaguugauacuaa

SEQ ID NO: 2414 - RNA, 20 nt, Homo sapiens
uuuaaaaaguugauacuaau

SEQ ID NO: 2415 - RNA, 20 nt, Homo sapiens
uuaaaaaguugauacuaauu

SEQ ID NO: 2416 - RNA, 20 nt, Homo sapiens
uaaaaaguugauacuaauuu

SEQ ID NO: 2417 - RNA, 20 nt, Homo sapiens
aaaaaguugauacuaauuua

SEQ ID NO: 2418 - RNA, 20 nt, Homo sapiens
aaaaguugauacuaauuuau

SEQ ID NO: 2419 - RNA, 20 nt, Homo sapiens
aaaguugauacuaauuuaua

SEQ ID NO: 2420 - RNA, 20 nt, Homo sapiens
aaguugauacuaauuuauaa

SEQ ID NO: 2421 - RNA, 20 nt, Homo sapiens
aguugauacuaauuuauaac

SEQ ID NO: 2422 - RNA, 20 nt, Homo sapiens
guugauacuaauuuauaacc

SEQ ID NO: 2423 - RNA, 20 nt, Homo sapiens
uugauacuaauuuauaaccu

SEQ ID NO: 2424 - RNA, 20 nt, Homo sapiens
ugauacuaauuuauaaccug

SEQ ID NO: 2425 - RNA, 20 nt, Homo sapiens
gauacuaauuuauaaccugu

SEQ ID NO: 2426 - RNA, 20 nt, Homo sapiens
auacuaauuuauaaccugua

SEQ ID NO: 2427 - RNA, 20 nt, Homo sapiens
uacuaauuuauaaccuguaa

SEQ ID NO: 2428 - RNA, 20 nt, Homo sapiens
acuaauuuauaaccuguaau

SEQ ID NO: 2429 - RNA, 20 nt, Homo sapiens
cuaauuuauaaccuguaauu

SEQ ID NO: 2430 - RNA, 20 nt, Homo sapiens
uaauuuauaaccuguaauug

SEQ ID NO: 2431 - RNA, 20 nt, Homo sapiens
aauuuauaaccuguaauugu

SEQ ID NO: 2432 - RNA, 20 nt, Homo sapiens
auuuauaaccuguaauuguu

SEQ ID NO: 2433 - RNA, 20 nt, Homo sapiens
uuuauaaccuguaauuguua

SEQ ID NO: 2434 - RNA, 20 nt, Homo sapiens
uuauaaccuguaauuguuaa

SEQ ID NO: 2435 - RNA, 20 nt, Homo sapiens
uauaaccuguaauuguuaaa

SEQ ID NO: 2436 - RNA, 20 nt, Homo sapiens
auaaccuguaauuguuaaau

SEQ ID NO: 2437 - RNA, 20 nt, Homo sapiens
uaaccuguaauuguuaaaug

SEQ ID NO: 2438 - RNA, 20 nt, Homo sapiens
aaccuguaauuguuaaaugu

SEQ ID NO: 2439 - RNA, 20 nt, Homo sapiens
accuguaauuguuaaaugug

SEQ ID NO: 2440 - RNA, 20 nt, Homo sapiens
ccuguaauuguuaaaugugc

SEQ ID NO: 2441 - RNA, 20 nt, Homo sapiens
cuguaauuguuaaaugugca

SEQ ID NO: 2442 - RNA, 20 nt, Homo sapiens
uguaauuguuaaaugugcau

SEQ ID NO: 2443 - RNA, 20 nt, Homo sapiens
guaauuguuaaaugugcaug

SEQ ID NO: 2444 - RNA, 20 nt, Homo sapiens
uaauuguuaaaugugcauga

SEQ ID NO: 2445 - RNA, 20 nt, Homo sapiens
aauuguuaaaugugcaugac

SEQ ID NO: 2446 - RNA, 20 nt, Homo sapiens
auuguuaaaugugcaugacu

SEQ ID NO: 2447 - RNA, 20 nt, Homo sapiens
uuguuaaaugugcaugacuu

SEQ ID NO: 2448 - RNA, 20 nt, Homo sapiens
uguuaaaugugcaugacuua

SEQ ID NO: 2449 - RNA, 20 nt, Homo sapiens
guuaaaugugcaugacuuaa

SEQ ID NO: 2450 - RNA, 20 nt, Homo sapiens
uuaaaugugcaugacuuaaa

SEQ ID NO: 2451 - RNA, 20 nt, Homo sapiens
uaaaugugcaugacuuaaau

SEQ ID NO: 2452 - RNA, 20 nt, Homo sapiens
aaaugugcaugacuuaaaug

SEQ ID NO: 2453 - RNA, 20 nt, Homo sapiens
aaugugcaugacuuaaaugu

SEQ ID NO: 2454 - RNA, 20 nt, Homo sapiens
augugcaugacuuaaauguu

SEQ ID NO: 2455 - RNA, 20 nt, Homo sapiens
ugugcaugacuuaaauguua

SEQ ID NO: 2456 - RNA, 20 nt, Homo sapiens
gugcaugacuuaaauguuaa

SEQ ID NO: 2457 - RNA, 20 nt, Homo sapiens
ugcaugacuuaaauguuaaa

SEQ ID NO: 2458 - RNA, 20 nt, Homo sapiens
gcaugacuuaaauguuaaaa

SEQ ID NO: 2459 - RNA, 20 nt, Homo sapiens
caugacuuaaauguuaaaau

SEQ ID NO: 2460 - RNA, 20 nt, Homo sapiens
augacuuaaauguuaaaauc

SEQ ID NO: 2461 - RNA, 20 nt, Homo sapiens
ugacuuaaauguuaaaaucc

SEQ ID NO: 2462 - RNA, 20 nt, Homo sapiens
gacuuaaauguuaaaauccu

SEQ ID NO: 2463 - RNA, 20 nt, Homo sapiens
acuuaaauguuaaaauccug

SEQ ID NO: 2464 - RNA, 20 nt, Homo sapiens
cuuaaauguuaaaauccugu

SEQ ID NO: 2465 - RNA, 20 nt, Homo sapiens
uuaaauguuaaaauccugua

SEQ ID NO: 2466 - RNA, 20 nt, Homo sapiens
uaaauguuaaaauccuguau

SEQ ID NO: 2467 - RNA, 20 nt, Homo sapiens
aaauguuaaaauccuguauu

SEQ ID NO: 2468 - RNA, 20 nt, Homo sapiens
aauguuaaaauccuguauuu

SEQ ID NO: 2469 - RNA, 20 nt, Homo sapiens
auguuaaaauccuguauuuu

SEQ ID NO: 2470 - RNA, 20 nt, Homo sapiens
uguuaaaauccuguauuuua

SEQ ID NO: 2471 - RNA, 20 nt, Homo sapiens
guuaaaauccuguauuuuaa

SEQ ID NO: 2472 - RNA, 20 nt, Homo sapiens
uuaaaauccuguauuuuaag

SEQ ID NO: 2473 - RNA, 20 nt, Homo sapiens
uaaaauccuguauuuuaaga

SEQ ID NO: 2474 - RNA, 20 nt, Homo sapiens
aaaauccuguauuuuaagau

SEQ ID NO: 2475 - RNA, 20 nt, Homo sapiens
aaauccuguauuuuaagaua

SEQ ID NO: 2476 - RNA, 20 nt, Homo sapiens
aauccuguauuuuaagauag

SEQ ID NO: 2477 - RNA, 20 nt, Homo sapiens
auccuguauuuuaagauagu

SEQ ID NO: 2478 - RNA, 20 nt, Homo sapiens
uccuguauuuuaagauaguc

SEQ ID NO: 2479 - RNA, 20 nt, Homo sapiens
ccuguauuuuaagauagucu

SEQ ID NO: 2480 - RNA, 20 nt, Homo sapiens
cuguauuuuaagauagucuu

SEQ ID NO: 2481 - RNA, 20 nt, Homo sapiens
uguauuuuaagauagucuuc

SEQ ID NO: 2482 - RNA, 20 nt, Homo sapiens
guauuuuaagauagucuucu

SEQ ID NO: 2483 - RNA, 20 nt, Homo sapiens
uauuuuaagauagucuucug

SEQ ID NO: 2484 - RNA, 20 nt, Homo sapiens
auuuuaagauagucuucugc

SEQ ID NO: 2485 - RNA, 20 nt, Homo sapiens
uuuuaagauagucuucugca

SEQ ID NO: 2486 - RNA, 20 nt, Homo sapiens
uuuaagauagucuucugcag

SEQ ID NO: 2487 - RNA, 20 nt, Homo sapiens
uuaagauagucuucugcagu

SEQ ID NO: 2488 - RNA, 20 nt, Homo sapiens
uaagauagucuucugcaguu

SEQ ID NO: 2489 - RNA, 20 nt, Homo sapiens
aagauagucuucugcaguua

SEQ ID NO: 2490 - RNA, 20 nt, Homo sapiens
agauagucuucugcaguuac

SEQ ID NO: 2491 - RNA, 20 nt, Homo sapiens
gauagucuucugcaguuaca

SEQ ID NO: 2492 - RNA, 20 nt, Homo sapiens
auagucuucugcaguuacaa

SEQ ID NO: 2493 - RNA, 20 nt, Homo sapiens
uagucuucugcaguuacaaa

SEQ ID NO: 2494 - RNA, 20 nt, Homo sapiens
agucuucugcaguuacaaau

SEQ ID NO: 2495 - RNA, 20 nt, Homo sapiens
gucuucugcaguuacaaauc

SEQ ID NO: 2496 - RNA, 20 nt, Homo sapiens
ucuucugcaguuacaaaucc

SEQ ID NO: 2497 - RNA, 20 nt, Homo sapiens
cuucugcaguuacaaaucca

SEQ ID NO: 2498 - RNA, 20 nt, Homo sapiens
uucugcaguuacaaauccau

SEQ ID NO: 2499 - RNA, 20 nt, Homo sapiens
ucugcaguuacaaauccaua

SEQ ID NO: 2500 - RNA, 20 nt, Homo sapiens
cugcaguuacaaauccauau

SEQ ID NO: 2501 - RNA, 20 nt, Homo sapiens
ugcaguuacaaauccauaua

SEQ ID NO: 2502 - RNA, 20 nt, Homo sapiens
gcaguuacaaauccauauac

SEQ ID NO: 2503 - RNA, 20 nt, Homo sapiens
caguuacaaauccauauacc

SEQ ID NO: 2504 - RNA, 20 nt, Homo sapiens
aguuacaaauccauauaccc

SEQ ID NO: 2505 - RNA, 20 nt, Homo sapiens
guuacaaauccauauaccca

SEQ ID NO: 2506 - RNA, 20 nt, Homo sapiens
uuacaaauccauauacccag

SEQ ID NO: 2507 - RNA, 20 nt, Homo sapiens
uacaaauccauauacccaga

SEQ ID NO: 2508 - RNA, 20 nt, Homo sapiens
acaaauccauauacccagau

SEQ ID NO: 2509 - RNA, 20 nt, Homo sapiens
caaauccauauacccagauu

SEQ ID NO: 2510 - RNA, 20 nt, Homo sapiens
aaauccauauacccagauuu

SEQ ID NO: 2511 - RNA, 20 nt, Homo sapiens
aauccauauacccagauuuc

SEQ ID NO: 2512 - RNA, 20 nt, Homo sapiens
auccauauacccagauuucc

SEQ ID NO: 2513 - RNA, 20 nt, Homo sapiens
uccauauacccagauuuccu

SEQ ID NO: 2514 - RNA, 20 nt, Homo sapiens
ccauauacccagauuuccug

SEQ ID NO: 2515 - RNA, 20 nt, Homo sapiens
cauauacccagauuuccugu

SEQ ID NO: 2516 - RNA, 20 nt, Homo sapiens
auauacccagauuuccugua

SEQ ID NO: 2517 - RNA, 20 nt, Homo sapiens
uauacccagauuuccuguag

SEQ ID NO: 2518 - RNA, 20 nt, Homo sapiens
auacccagauuuccuguagg

SEQ ID NO: 2519 - RNA, 20 nt, Homo sapiens
uacccagauuuccuguaggc

SEQ ID NO: 2520 - RNA, 20 nt, Homo sapiens
acccagauuuccuguaggcu

SEQ ID NO: 2521 - RNA, 20 nt, Homo sapiens
cccagauuuccuguaggcuu

SEQ ID NO: 2522 - RNA, 20 nt, Homo sapiens
ccagauuuccuguaggcuuc

SEQ ID NO: 2523 - RNA, 20 nt, Homo sapiens
cagauuuccuguaggcuuca

SEQ ID NO: 2524 - RNA, 20 nt, Homo sapiens
agauuuccuguaggcuucac

SEQ ID NO: 2525 - RNA, 20 nt, Homo sapiens
gauuuccuguaggcuucaca

SEQ ID NO: 2526 - RNA, 20 nt, Homo sapiens
auuuccuguaggcuucacaa

SEQ ID NO: 2527 - RNA, 20 nt, Homo sapiens
uuuccuguaggcuucacaaa

SEQ ID NO: 2528 - RNA, 20 nt, Homo sapiens
uuccuguaggcuucacaaau

SEQ ID NO: 2529 - RNA, 20 nt, Homo sapiens
uccuguaggcuucacaaauc

SEQ ID NO: 2530 - RNA, 20 nt, Homo sapiens
ccuguaggcuucacaaaucg

SEQ ID NO: 2531 - RNA, 20 nt, Homo sapiens
cuguaggcuucacaaaucgg

SEQ ID NO: 2532 - RNA, 20 nt, Homo sapiens
uguaggcuucacaaaucgga

SEQ ID NO: 2533 - RNA, 20 nt, Homo sapiens
guaggcuucacaaaucggag

SEQ ID NO: 2534 - RNA, 20 nt, Homo sapiens
uaggcuucacaaaucggagg

SEQ ID NO: 2535 - RNA, 20 nt, Homo sapiens
aggcuucacaaaucggaggg

SEQ ID NO: 2536 - RNA, 20 nt, Homo sapiens
ggcuucacaaaucggagggg

SEQ ID NO: 2537 - RNA, 20 nt, Homo sapiens
gcuucacaaaucggaggggu

SEQ ID NO: 2538 - RNA, 20 nt, Homo sapiens
cuucacaaaucggaggggua

SEQ ID NO: 2539 - RNA, 20 nt, Homo sapiens
uucacaaaucggagggguac

SEQ ID NO: 2540 - RNA, 20 nt, Homo sapiens
ucacaaaucggagggguaca

SEQ ID NO: 2541 - RNA, 20 nt, Homo sapiens
cacaaaucggagggguacau

SEQ ID NO: 2542 - RNA, 20 nt, Homo sapiens
acaaaucggagggguacaua

SEQ ID NO: 2543 - RNA, 20 nt, Homo sapiens
caaaucggagggguacauag

SEQ ID NO: 2544 - RNA, 20 nt, Homo sapiens
aaaucggagggguacauaga

SEQ ID NO: 2545 - RNA, 20 nt, Homo sapiens
aaucggagggguacauagaa

SEQ ID NO: 2546 - RNA, 20 nt, Homo sapiens
aucggagggguacauagaau

SEQ ID NO: 2547 - RNA, 20 nt, Homo sapiens
ucggagggguacauagaaug

SEQ ID NO: 2548 - RNA, 20 nt, Homo sapiens
cggagggguacauagaaugu

SEQ ID NO: 2549 - RNA, 20 nt, Homo sapiens
ggagggguacauagaaugug

SEQ ID NO: 2550 - RNA, 20 nt, Homo sapiens
gagggguacauagaaugugc

SEQ ID NO: 2551 - RNA, 20 nt, Homo sapiens
agggguacauagaaugugca

SEQ ID NO: 2552 - RNA, 20 nt, Homo sapiens
gggguacauagaaugugcaa

SEQ ID NO: 2553 - RNA, 20 nt, Homo sapiens
ggguacauagaaugugcaag

SEQ ID NO: 2554 - RNA, 20 nt, Homo sapiens
gguacauagaaugugcaaga

SEQ ID NO: 2555 - RNA, 20 nt, Homo sapiens
guacauagaaugugcaagag

SEQ ID NO: 2556 - RNA, 20 nt, Homo sapiens
uacauagaaugugcaagagu

SEQ ID NO: 2557 - RNA, 20 nt, Homo sapiens
acauagaaugugcaagaguc

SEQ ID NO: 2558 - RNA, 20 nt, Homo sapiens
cauagaaugugcaagaguca

SEQ ID NO: 2559 - RNA, 20 nt, Homo sapiens
auagaaugugcaagagucaa

SEQ ID NO: 2560 - RNA, 20 nt, Homo sapiens
uagaaugugcaagagucaaa

SEQ ID NO: 2561 - RNA, 20 nt, Homo sapiens
agaaugugcaagagucaaag

SEQ ID NO: 2562 - RNA, 20 nt, Homo sapiens
gaaugugcaagagucaaagg

SEQ ID NO: 2563 - RNA, 20 nt, Homo sapiens
aaugugcaagagucaaagga

SEQ ID NO: 2564 - RNA, 20 nt, Homo sapiens
augugcaagagucaaaggau

SEQ ID NO: 2565 - RNA, 20 nt, Homo sapiens
ugugcaagagucaaaggaua

SEQ ID NO: 2566 - RNA, 20 nt, Homo sapiens
gugcaagagucaaaggauaa

SEQ ID NO: 2567 - RNA, 20 nt, Homo sapiens
ugcaagagucaaaggauaaa

SEQ ID NO: 2568 - RNA, 20 nt, Homo sapiens
gcaagagucaaaggauaaau

SEQ ID NO: 2569 - RNA, 20 nt, Homo sapiens
caagagucaaaggauaaaua

SEQ ID NO: 2570 - RNA, 20 nt, Homo sapiens
aagagucaaaggauaaauaa

SEQ ID NO: 2571 - RNA, 20 nt, Homo sapiens
agagucaaaggauaaauaau

SEQ ID NO: 2572 - RNA, 20 nt, Homo sapiens
gagucaaaggauaaauaaua

SEQ ID NO: 2573 - RNA, 20 nt, Homo sapiens
agucaaaggauaaauaauau

SEQ ID NO: 2574 - RNA, 20 nt, Homo sapiens
gucaaaggauaaauaauauu

SEQ ID NO: 2575 - RNA, 20 nt, Homo sapiens
ucaaaggauaaauaauauua

SEQ ID NO: 2576 - RNA, 20 nt, Homo sapiens
caaaggauaaauaauauuau

SEQ ID NO: 2577 - RNA, 20 nt, Homo sapiens
aaaggauaaauaauauuaua

SEQ ID NO: 2578 - RNA, 20 nt, Homo sapiens
aaggauaaauaauauuauaa

SEQ ID NO: 2579 - RNA, 20 nt, Homo sapiens
aggauaaauaauauuauaaa

SEQ ID NO: 2580 - RNA, 20 nt, Homo sapiens
ggauaaauaauauuauaaau

SEQ ID NO: 2581 - RNA, 20 nt, Homo sapiens
gauaaauaauauuauaaaua

SEQ ID NO: 2582 - RNA, 20 nt, Homo sapiens
auaaauaauauuauaaauau

SEQ ID NO: 2583 - RNA, 20 nt, Homo sapiens
uaaauaauauuauaaauaua

SEQ ID NO: 2584 - RNA, 20 nt, Homo sapiens
aaauaauauuauaaauauau

SEQ ID NO: 2585 - RNA, 20 nt, Homo sapiens
aauaauauuauaaauauaua

SEQ ID NO: 2586 - RNA, 20 nt, Homo sapiens
auaauauuauaaauauauau

SEQ ID NO: 2587 - RNA, 20 nt, Homo sapiens
uaauauuauaaauauauauu

SEQ ID NO: 2588 - RNA, 20 nt, Homo sapiens
aauauuauaaauauauauua

SEQ ID NO: 2589 - RNA, 20 nt, Homo sapiens
auauuauaaauauauauuaa

SEQ ID NO: 2590 - RNA, 20 nt, Homo sapiens
uauuauaaauauauauuaac

SEQ ID NO: 2591 - RNA, 20 nt, Homo sapiens
auuauaaauauauauuaacu

SEQ ID NO: 2592 - RNA, 20 nt, Homo sapiens
uuauaaauauauauuaacua

SEQ ID NO: 2593 - RNA, 20 nt, Homo sapiens
uauaaauauauauuaacuau

SEQ ID NO: 2594 - RNA, 20 nt, Homo sapiens
auaaauauauauuaacuaua

SEQ ID NO: 2595 - RNA, 20 nt, Homo sapiens
uaaauauauauuaacuauau

SEQ ID NO: 2596 - RNA, 20 nt, Homo sapiens
aaauauauauuaacuauauu

SEQ ID NO: 2597 - RNA, 20 nt, Homo sapiens
aauauauauuaacuauauua

SEQ ID NO: 2598 - RNA, 20 nt, Homo sapiens
auauauauuaacuauauuac

SEQ ID NO: 2599 - RNA, 20 nt, Homo sapiens
uauauauuaacuauauuacc

SEQ ID NO: 2600 - RNA, 20 nt, Homo sapiens
auauauuaacuauauuaccu

SEQ ID NO: 2601 - RNA, 20 nt, Homo sapiens
uauauuaacuauauuaccua

SEQ ID NO: 2602 - RNA, 20 nt, Homo sapiens
auauuaacuauauuaccuaa

SEQ ID NO: 2603 - RNA, 20 nt, Homo sapiens
uauuaacuauauuaccuaau

SEQ ID NO: 2604 - RNA, 20 nt, Homo sapiens
auuaacuauauuaccuaauu

SEQ ID NO: 2605 - RNA, 20 nt, Homo sapiens
uuaacuauauuaccuaauua

SEQ ID NO: 2606 - RNA, 20 nt, Homo sapiens
uaacuauauuaccuaauuaa

SEQ ID NO: 2607 - RNA, 20 nt, Homo sapiens
aacuauauuaccuaauuaaa

SEQ ID NO: 2608 - RNA, 20 nt, Homo sapiens
acuauauuaccuaauuaaaa

SEQ ID NO: 2609 - RNA, 20 nt, Homo sapiens
cuauauuaccuaauuaaaac

SEQ ID NO: 2610 - RNA, 20 nt, Homo sapiens
uauauuaccuaauuaaaacc

SEQ ID NO: 2611 - RNA, 20 nt, Homo sapiens
auauuaccuaauuaaaacca

SEQ ID NO: 2612 - RNA, 20 nt, Homo sapiens
uauuaccuaauuaaaaccau

SEQ ID NO: 2613 - RNA, 20 nt, Homo sapiens
auuaccuaauuaaaaccaua

SEQ ID NO: 2614 - RNA, 20 nt, Homo sapiens
uuaccuaauuaaaaccauaa

SEQ ID NO: 2615 - RNA, 20 nt, Homo sapiens
uaccuaauuaaaaccauaau

SEQ ID NO: 2616 - RNA, 20 nt, Homo sapiens
accuaauuaaaaccauaauc

SEQ ID NO: 2617 - RNA, 20 nt, Homo sapiens
ccuaauuaaaaccauaaucu

SEQ ID NO: 2618 - RNA, 20 nt, Homo sapiens
cuaauuaaaaccauaaucug

SEQ ID NO: 2619 - RNA, 20 nt, Homo sapiens
uaauuaaaaccauaaucugu

SEQ ID NO: 2620 - RNA, 20 nt, Homo sapiens
aauuaaaaccauaaucuguu

SEQ ID NO: 2621 - RNA, 20 nt, Homo sapiens
auuaaaaccauaaucuguua

SEQ ID NO: 2622 - RNA, 20 nt, Homo sapiens
uuaaaaccauaaucuguuaa

SEQ ID NO: 2623 - RNA, 20 nt, Homo sapiens
uaaaaccauaaucuguuaau

SEQ ID NO: 2624 - RNA, 20 nt, Homo sapiens
aaaaccauaaucuguuaaua

SEQ ID NO: 2625 - RNA, 20 nt, Homo sapiens
aaaccauaaucuguuaauac

SEQ ID NO: 2626 - RNA, 20 nt, Homo sapiens
aaccauaaucuguuaauaca

SEQ ID NO: 2627 - RNA, 20 nt, Homo sapiens
accauaaucuguuaauacag

SEQ ID NO: 2628 - RNA, 20 nt, Homo sapiens
ccauaaucuguuaauacagc

SEQ ID NO: 2629 - RNA, 20 nt, Homo sapiens
cauaaucuguuaauacagcu

SEQ ID NO: 2630 - RNA, 20 nt, Homo sapiens
auaaucuguuaauacagcua

SEQ ID NO: 2631 - RNA, 20 nt, Homo sapiens
uaaucuguuaauacagcuau

SEQ ID NO: 2632 - RNA, 20 nt, Homo sapiens
aaucuguuaauacagcuaug

SEQ ID NO: 2633 - RNA, 20 nt, Homo sapiens
aucuguuaauacagcuaugg

SEQ ID NO: 2634 - RNA, 20 nt, Homo sapiens
ucuguuaauacagcuaugga

SEQ ID NO: 2635 - RNA, 20 nt, Homo sapiens
cuguuaauacagcuauggau

SEQ ID NO: 2636 - RNA, 20 nt, Homo sapiens
uguuaauacagcuauggauu

SEQ ID NO: 2637 - RNA, 20 nt, Homo sapiens
guuaauacagcuauggauua

SEQ ID NO: 2638 - RNA, 20 nt, Homo sapiens
uuaauacagcuauggauuaa

SEQ ID NO: 2639 - RNA, 20 nt, Homo sapiens
uaauacagcuauggauuaau

SEQ ID NO: 2640 - RNA, 20 nt, Homo sapiens
aauacagcuauggauuaauu

SEQ ID NO: 2641 - RNA, 20 nt, Homo sapiens
auacagcuauggauuaauuu

SEQ ID NO: 2642 - RNA, 20 nt, Homo sapiens
uacagcuauggauuaauuuc

SEQ ID NO: 2643 - RNA, 20 nt, Homo sapiens
acagcuauggauuaauuuca

SEQ ID NO: 2644 - RNA, 20 nt, Homo sapiens
cagcuauggauuaauuucaa

SEQ ID NO: 2645 - RNA, 20 nt, Homo sapiens
agcuauggauuaauuucaaa

SEQ ID NO: 2646 - RNA, 20 nt, Homo sapiens
gcuauggauuaauuucaaaa

SEQ ID NO: 2647 - RNA, 20 nt, Homo sapiens
cuauggauuaauuucaaaaa

SEQ ID NO: 2648 - RNA, 20 nt, Homo sapiens
uauggauuaauuucaaaaaa

SEQ ID NO: 2649 - RNA, 20 nt, Homo sapiens
auggauuaauuucaaaaaaa

SEQ ID NO: 2650 - RNA, 20 nt, Homo sapiens
uggauuaauuucaaaaaaau

SEQ ID NO: 2651 - RNA, 20 nt, Homo sapiens
ggauuaauuucaaaaaaaug

SEQ ID NO: 2652 - RNA, 20 nt, Homo sapiens
gauuaauuucaaaaaaaugu

SEQ ID NO: 2653 - RNA, 20 nt, Homo sapiens
auuaauuucaaaaaaaugua

SEQ ID NO: 2654 - RNA, 20 nt, Homo sapiens
uuaauuucaaaaaaauguaa

SEQ ID NO: 2655 - RNA, 20 nt, Homo sapiens
uaauuucaaaaaaauguaau

SEQ ID NO: 2656 - RNA, 20 nt, Homo sapiens
aauuucaaaaaaauguaauc

SEQ ID NO: 2657 - RNA, 20 nt, Homo sapiens
auuucaaaaaaauguaauca

SEQ ID NO: 2658 - RNA, 20 nt, Homo sapiens
uuucaaaaaaauguaaucaa

SEQ ID NO: 2659 - RNA, 20 nt, Homo sapiens
uucaaaaaaauguaaucaaa

SEQ ID NO: 2660 - RNA, 20 nt, Homo sapiens
ucaaaaaaauguaaucaaau

SEQ ID NO: 2661 - RNA, 20 nt, Homo sapiens
caaaaaaauguaaucaaaua

SEQ ID NO: 2662 - RNA, 20 nt, Homo sapiens
aaaaaaauguaaucaaauau

SEQ ID NO: 2663 - RNA, 20 nt, Homo sapiens
aaaaaauguaaucaaauaua

SEQ ID NO: 2664 - RNA, 20 nt, Homo sapiens
aaaaauguaaucaaauauau

SEQ ID NO: 2665 - RNA, 20 nt, Homo sapiens
aaaauguaaucaaauauauu

SEQ ID NO: 2666 - RNA, 20 nt, Homo sapiens
aaauguaaucaaauauauua

SEQ ID NO: 2667 - RNA, 20 nt, Homo sapiens
aauguaaucaaauauauuac

SEQ ID NO: 2668 - RNA, 20 nt, Homo sapiens
auguaaucaaauauauuacu

SEQ ID NO: 2669 - RNA, 20 nt, Homo sapiens
uguaaucaaauauauuacua

SEQ ID NO: 2670 - RNA, 20 nt, Homo sapiens
guaaucaaauauauuacuaa

SEQ ID NO: 2671 - RNA, 20 nt, Homo sapiens
uaaucaaauauauuacuaau

SEQ ID NO: 2672 - RNA, 20 nt, Homo sapiens
aaucaaauauauuacuaaug

SEQ ID NO: 2673 - RNA, 20 nt, Homo sapiens
aucaaauauauuacuaaugg

SEQ ID NO: 2674 - RNA, 20 nt, Homo sapiens
ucaaauauauuacuaauggu

SEQ ID NO: 2675 - RNA, 20 nt, Homo sapiens
caaauauauuacuaauggug

SEQ ID NO: 2676 - RNA, 20 nt, Homo sapiens
aaauauauuacuaauggugu

SEQ ID NO: 2677 - RNA, 20 nt, Homo sapiens
aauauauuacuaauggugua

SEQ ID NO: 2678 - RNA, 20 nt, Homo sapiens
auauauuacuaaugguguag

SEQ ID NO: 2679 - RNA, 20 nt, Homo sapiens
uauauuacuaaugguguagu

SEQ ID NO: 2680 - RNA, 20 nt, Homo sapiens
auauuacuaaugguguaguu

SEQ ID NO: 2681 - RNA, 20 nt, Homo sapiens
uauuacuaaugguguaguug

SEQ ID NO: 2682 - RNA, 20 nt, Homo sapiens
auuacuaaugguguaguugg

SEQ ID NO: 2683 - RNA, 20 nt, Homo sapiens
uuacuaaugguguaguuggc

SEQ ID NO: 2684 - RNA, 20 nt, Homo sapiens
uacuaaugguguaguuggcu

SEQ ID NO: 2685 - RNA, 20 nt, Homo sapiens
acuaaugguguaguuggcug

SEQ ID NO: 2686 - RNA, 20 nt, Homo sapiens
cuaaugguguaguuggcugu

SEQ ID NO: 2687 - RNA, 20 nt, Homo sapiens
uaaugguguaguuggcuguu

SEQ ID NO: 2688 - RNA, 20 nt, Homo sapiens
aaugguguaguuggcuguuu

SEQ ID NO: 2689 - RNA, 20 nt, Homo sapiens
augguguaguuggcuguuuu

SEQ ID NO: 2690 - RNA, 20 nt, Homo sapiens
ugguguaguuggcuguuuuc

SEQ ID NO: 2691 - RNA, 20 nt, Homo sapiens
gguguaguuggcuguuuucc

SEQ ID NO: 2692 - RNA, 20 nt, Homo sapiens
guguaguuggcuguuuucca

SEQ ID NO: 2693 - RNA, 20 nt, Homo sapiens
uguaguuggcuguuuuccaa

SEQ ID NO: 2694 - RNA, 20 nt, Homo sapiens
guaguuggcuguuuuccaau

SEQ ID NO: 2695 - RNA, 20 nt, Homo sapiens
uaguuggcuguuuuccaaug

SEQ ID NO: 2696 - RNA, 20 nt, Homo sapiens
aguuggcuguuuuccaaugu

SEQ ID NO: 2697 - RNA, 20 nt, Homo sapiens
guuggcuguuuuccaauguu

SEQ ID NO: 2698 - RNA, 20 nt, Homo sapiens
uuggcuguuuuccaauguug

SEQ ID NO: 2699 - RNA, 20 nt, Homo sapiens
uggcuguuuuccaauguugg

SEQ ID NO: 2700 - RNA, 20 nt, Homo sapiens
ggcuguuuuccaauguuggu

SEQ ID NO: 2701 - RNA, 20 nt, Homo sapiens
gcuguuuuccaauguuggua

SEQ ID NO: 2702 - RNA, 20 nt, Homo sapiens
cuguuuuccaauguugguaa

SEQ ID NO: 2703 - RNA, 20 nt, Homo sapiens
uguuuuccaauguugguaaa

SEQ ID NO: 2704 - RNA, 20 nt, Homo sapiens
guuuuccaauguugguaaag

SEQ ID NO: 2705 - RNA, 20 nt, Homo sapiens
uuuuccaauguugguaaagu

SEQ ID NO: 2706 - RNA, 20 nt, Homo sapiens
uuuccaauguugguaaaguu

SEQ ID NO: 2707 - RNA, 20 nt, Homo sapiens
uuccaauguugguaaaguua

SEQ ID NO: 2708 - RNA, 20 nt, Homo sapiens
uccaauguugguaaaguuau

SEQ ID NO: 2709 - RNA, 20 nt, Homo sapiens
ccaauguugguaaaguuauu

SEQ ID NO: 2710 - RNA, 20 nt, Homo sapiens
caauguugguaaaguuauua

SEQ ID NO: 2711 - RNA, 20 nt, Homo sapiens
aauguugguaaaguuauuaa

SEQ ID NO: 2712 - RNA, 20 nt, Homo sapiens
auguugguaaaguuauuaaa

SEQ ID NO: 2713 - RNA, 20 nt, Homo sapiens
uguugguaaaguuauuaaag

SEQ ID NO: 2714 - RNA, 20 nt, Homo sapiens
guugguaaaguuauuaaagu

SEQ ID NO: 2715 - RNA, 20 nt, Homo sapiens
uugguaaaguuauuaaaguu

SEQ ID NO: 2716 - RNA, 20 nt, Homo sapiens
ugguaaaguuauuaaaguuc

SEQ ID NO: 2717 - RNA, 20 nt, Homo sapiens
gguaaaguuauuaaaguucu

SEQ ID NO: 2718 - RNA, 20 nt, Homo sapiens
guaaaguuauuaaaguucuu

SEQ ID NO: 2719 - RNA, 20 nt, Homo sapiens
uaaaguuauuaaaguucuuc

SEQ ID NO: 2720 - RNA, 20 nt, Homo sapiens
aaaguuauuaaaguucuuca

SEQ ID NO: 2721 - RNA, 20 nt, Homo sapiens
aaguuauuaaaguucuucac

SEQ ID NO: 2722 - RNA, 20 nt, Homo sapiens
aguuauuaaaguucuucacu

SEQ ID NO: 2723 - RNA, 20 nt, Homo sapiens
guuauuaaaguucuucacuu

SEQ ID NO: 2724 - RNA, 20 nt, Homo sapiens
uuauuaaaguucuucacuuu

SEQ ID NO: 2725 - RNA, 20 nt, Homo sapiens
uauuaaaguucuucacuuuc

SEQ ID NO: 2726 - RNA, 20 nt, Homo sapiens
auuaaaguucuucacuuuca

SEQ ID NO: 2727 - RNA, 20 nt, Homo sapiens
uuaaaguucuucacuuucau

SEQ ID NO: 2728 - RNA, 20 nt, Homo sapiens
uaaaguucuucacuuucaua

SEQ ID NO: 2729 - RNA, 20 nt, Homo sapiens
aaaguucuucacuuucauag

SEQ ID NO: 2730 - RNA, 20 nt, Homo sapiens
aaguucuucacuuucauaga

SEQ ID NO: 2731 - RNA, 20 nt, Homo sapiens
aguucuucacuuucauagag

SEQ ID NO: 2732 - RNA, 20 nt, Homo sapiens
guucuucacuuucauagagu

SEQ ID NO: 2733 - RNA, 20 nt, Homo sapiens
uucuucacuuucauagaguc

SEQ ID NO: 2734 - RNA, 20 nt, Homo sapiens
ucuucacuuucauagagucc

SEQ ID NO: 2735 - RNA, 20 nt, Homo sapiens
cuucacuuucauagagucca

SEQ ID NO: 2736 - RNA, 20 nt, Homo sapiens
uucacuuucauagaguccag

SEQ ID NO: 2737 - RNA, 20 nt, Homo sapiens
ucacuuucauagaguccaga

SEQ ID NO: 2738 - RNA, 20 nt, Homo sapiens
cacuuucauagaguccagau

SEQ ID NO: 2739 - RNA, 20 nt, Homo sapiens
acuuucauagaguccagauu

SEQ ID NO: 2740 - RNA, 20 nt, Homo sapiens
cuuucauagaguccagauug

SEQ ID NO: 2741 - RNA, 20 nt, Homo sapiens
uuucauagaguccagauuga

SEQ ID NO: 2742 - RNA, 20 nt, Homo sapiens
uucauagaguccagauugag

SEQ ID NO: 2743 - RNA, 20 nt, Homo sapiens
ucauagaguccagauugagc

SEQ ID NO: 2744 - RNA, 20 nt, Homo sapiens
cauagaguccagauugagcu

SEQ ID NO: 2745 - RNA, 20 nt, Homo sapiens
auagaguccagauugagcug

SEQ ID NO: 2746 - RNA, 20 nt, Homo sapiens
uagaguccagauugagcugc

SEQ ID NO: 2747 - RNA, 20 nt, Homo sapiens
agaguccagauugagcugcc

SEQ ID NO: 2748 - RNA, 20 nt, Homo sapiens
gaguccagauugagcugcca

SEQ ID NO: 2749 - RNA, 20 nt, Homo sapiens
aguccagauugagcugccaa

SEQ ID NO: 2750 - RNA, 20 nt, Homo sapiens
guccagauugagcugccaaa

SEQ ID NO: 2751 - RNA, 20 nt, Homo sapiens
uccagauugagcugccaaac

SEQ ID NO: 2752 - RNA, 20 nt, Homo sapiens
ccagauugagcugccaaacg

SEQ ID NO: 2753 - RNA, 20 nt, Homo sapiens
cagauugagcugccaaacgc

SEQ ID NO: 2754 - RNA, 20 nt, Homo sapiens
agauugagcugccaaacgcu

SEQ ID NO: 2755 - RNA, 20 nt, Homo sapiens
gauugagcugccaaacgcug

SEQ ID NO: 2756 - RNA, 20 nt, Homo sapiens
auugagcugccaaacgcuga

SEQ ID NO: 2757 - RNA, 20 nt, Homo sapiens
uugagcugccaaacgcugaa

SEQ ID NO: 2758 - RNA, 20 nt, Homo sapiens
ugagcugccaaacgcugaaa

SEQ ID NO: 2759 - RNA, 20 nt, Homo sapiens
gagcugccaaacgcugaaau

SEQ ID NO: 2760 - RNA, 20 nt, Homo sapiens
agcugccaaacgcugaaauu

SEQ ID NO: 2761 - RNA, 20 nt, Homo sapiens
gcugccaaacgcugaaauuc

SEQ ID NO: 2762 - RNA, 20 nt, Homo sapiens
cugccaaacgcugaaauucu

SEQ ID NO: 2763 - RNA, 20 nt, Homo sapiens
ugccaaacgcugaaauucuc

SEQ ID NO: 2764 - RNA, 20 nt, Homo sapiens
gccaaacgcugaaauucucc

SEQ ID NO: 2765 - RNA, 20 nt, Homo sapiens
ccaaacgcugaaauucuccu

SEQ ID NO: 2766 - RNA, 20 nt, Homo sapiens
caaacgcugaaauucuccuu

SEQ ID NO: 2767 - RNA, 20 nt, Homo sapiens
aaacgcugaaauucuccuuc

SEQ ID NO: 2768 - RNA, 20 nt, Homo sapiens
aacgcugaaauucuccuucu

SEQ ID NO: 2769 - RNA, 20 nt, Homo sapiens
acgcugaaauucuccuucug

SEQ ID NO: 2770 - RNA, 20 nt, Homo sapiens
cgcugaaauucuccuucugg

SEQ ID NO: 2771 - RNA, 20 nt, Homo sapiens
gcugaaauucuccuucuggg

SEQ ID NO: 2772 - RNA, 20 nt, Homo sapiens
cugaaauucuccuucugggu

SEQ ID NO: 2773 - RNA, 20 nt, Homo sapiens
ugaaauucuccuucuggguu

SEQ ID NO: 2774 - RNA, 20 nt, Homo sapiens
gaaauucuccuucuggguua

SEQ ID NO: 2775 - RNA, 20 nt, Homo sapiens
aaauucuccuucuggguuaa

SEQ ID NO: 2776 - RNA, 20 nt, Homo sapiens
aauucuccuucuggguuaaa

SEQ ID NO: 2777 - RNA, 20 nt, Homo sapiens
auucuccuucuggguuaaaa

SEQ ID NO: 2778 - RNA, 20 nt, Homo sapiens
uucuccuucuggguuaaaag

SEQ ID NO: 2779 - RNA, 20 nt, Homo sapiens
ucuccuucuggguuaaaagc

SEQ ID NO: 2780 - RNA, 20 nt, Homo sapiens
cuccuucuggguuaaaagcu

SEQ ID NO: 2781 - RNA, 20 nt, Homo sapiens
uccuucuggguuaaaagcuu

SEQ ID NO: 2782 - RNA, 20 nt, Homo sapiens
ccuucuggguuaaaagcuug

SEQ ID NO: 2783 - RNA, 20 nt, Homo sapiens
cuucuggguuaaaagcuugu

SEQ ID NO: 2784 - RNA, 20 nt, Homo sapiens
uucuggguuaaaagcuuguu

SEQ ID NO: 2785 - RNA, 20 nt, Homo sapiens
ucuggguuaaaagcuuguuu

SEQ ID NO: 2786 - RNA, 20 nt, Homo sapiens
cuggguuaaaagcuuguuuu

SEQ ID NO: 2787 - RNA, 20 nt, Homo sapiens
uggguuaaaagcuuguuuua

SEQ ID NO: 2788 - RNA, 20 nt, Homo sapiens
ggguuaaaagcuuguuuuac

SEQ ID NO: 2789 - RNA, 20 nt, Homo sapiens
gguuaaaagcuuguuuuaca

SEQ ID NO: 2790 - RNA, 20 nt, Homo sapiens
guuaaaagcuuguuuuacau

SEQ ID NO: 2791 - RNA, 20 nt, Homo sapiens
uuaaaagcuuguuuuacauu

SEQ ID NO: 2792 - RNA, 20 nt, Homo sapiens
uaaaagcuuguuuuacauuc

SEQ ID NO: 2793 - RNA, 20 nt, Homo sapiens
aaaagcuuguuuuacauuca

SEQ ID NO: 2794 - RNA, 20 nt, Homo sapiens
aaagcuuguuuuacauucaa

SEQ ID NO: 2795 - RNA, 20 nt, Homo sapiens
aagcuuguuuuacauucaaa

SEQ ID NO: 2796 - RNA, 20 nt, Homo sapiens
agcuuguuuuacauucaaac

SEQ ID NO: 2797 - RNA, 20 nt, Homo sapiens
gcuuguuuuacauucaaacc

SEQ ID NO: 2798 - RNA, 20 nt, Homo sapiens
cuuguuuuacauucaaaccu

SEQ ID NO: 2799 - RNA, 20 nt, Homo sapiens
uuguuuuacauucaaaccuu

SEQ ID NO: 2800 - RNA, 20 nt, Homo sapiens
uguuuuacauucaaaccuuu

SEQ ID NO: 2801 - RNA, 20 nt, Homo sapiens
guuuuacauucaaaccuuuc

SEQ ID NO: 2802 - RNA, 20 nt, Homo sapiens
uuuuacauucaaaccuuucc

SEQ ID NO: 2803 - RNA, 20 nt, Homo sapiens
uuuacauucaaaccuuuccc

SEQ ID NO: 2804 - RNA, 20 nt, Homo sapiens
uuacauucaaaccuuuccca

SEQ ID NO: 2805 - RNA, 20 nt, Homo sapiens
uacauucaaaccuuucccau

SEQ ID NO: 2806 - RNA, 20 nt, Homo sapiens
acauucaaaccuuucccauu

SEQ ID NO: 2807 - RNA, 20 nt, Homo sapiens
cauucaaaccuuucccauua

SEQ ID NO: 2808 - RNA, 20 nt, Homo sapiens
auucaaaccuuucccauuaa

SEQ ID NO: 2809 - RNA, 20 nt, Homo sapiens
uucaaaccuuucccauuaag

SEQ ID NO: 2810 - RNA, 20 nt, Homo sapiens
ucaaaccuuucccauuaagu

SEQ ID NO: 2811 - RNA, 20 nt, Homo sapiens
caaaccuuucccauuaagug

SEQ ID NO: 2812 - RNA, 20 nt, Homo sapiens
aaaccuuucccauuaagugc

SEQ ID NO: 2813 - RNA, 20 nt, Homo sapiens
aaccuuucccauuaagugcu

SEQ ID NO: 2814 - RNA, 20 nt, Homo sapiens
accuuucccauuaagugcua

SEQ ID NO: 2815 - RNA, 20 nt, Homo sapiens
ccuuucccauuaagugcuaa

SEQ ID NO: 2816 - RNA, 20 nt, Homo sapiens
cuuucccauuaagugcuaaa

SEQ ID NO: 2817 - RNA, 20 nt, Homo sapiens
uuucccauuaagugcuaaau

SEQ ID NO: 2818 - RNA, 20 nt, Homo sapiens
uucccauuaagugcuaaaua

SEQ ID NO: 2819 - RNA, 20 nt, Homo sapiens
ucccauuaagugcuaaauau

SEQ ID NO: 2820 - RNA, 20 nt, Homo sapiens
cccauuaagugcuaaauauu

SEQ ID NO: 2821 - RNA, 20 nt, Homo sapiens
ccauuaagugcuaaauauuu

SEQ ID NO: 2822 - RNA, 20 nt, Homo sapiens
cauuaagugcuaaauauuug

SEQ ID NO: 2823 - RNA, 20 nt, Homo sapiens
auuaagugcuaaauauuugc

SEQ ID NO: 2824 - RNA, 20 nt, Homo sapiens
uuaagugcuaaauauuugcu

SEQ ID NO: 2825 - RNA, 20 nt, Homo sapiens
uaagugcuaaauauuugcug

SEQ ID NO: 2826 - RNA, 20 nt, Homo sapiens
aagugcuaaauauuugcuga

SEQ ID NO: 2827 - RNA, 20 nt, Homo sapiens
agugcuaaauauuugcugaa

SEQ ID NO: 2828 - RNA, 20 nt, Homo sapiens
gugcuaaauauuugcugaau

SEQ ID NO: 2829 - RNA, 20 nt, Homo sapiens
ugcuaaauauuugcugaaug

SEQ ID NO: 2830 - RNA, 20 nt, Homo sapiens
gcuaaauauuugcugaaugu

SEQ ID NO: 2831 - RNA, 20 nt, Homo sapiens
cuaaauauuugcugaauguu

SEQ ID NO: 2832 - RNA, 20 nt, Homo sapiens
uaaauauuugcugaauguug

SEQ ID NO: 2833 - RNA, 20 nt, Homo sapiens
aaauauuugcugaauguugg

SEQ ID NO: 2834 - RNA, 20 nt, Homo sapiens
aauauuugcugaauguuggu

SEQ ID NO: 2835 - RNA, 20 nt, Homo sapiens
auauuugcugaauguugguc

SEQ ID NO: 2836 - RNA, 20 nt, Homo sapiens
uauuugcugaauguuggucg

SEQ ID NO: 2837 - RNA, 20 nt, Homo sapiens
auuugcugaauguuggucga

SEQ ID NO: 2838 - RNA, 20 nt, Homo sapiens
uuugcugaauguuggucgaa

SEQ ID NO: 2839 - RNA, 20 nt, Homo sapiens
uugcugaauguuggucgaac

SEQ ID NO: 2840 - RNA, 20 nt, Homo sapiens
ugcugaauguuggucgaacc

SEQ ID NO: 2841 - RNA, 20 nt, Homo sapiens
gcugaauguuggucgaaccc

SEQ ID NO: 2842 - RNA, 20 nt, Homo sapiens
cugaauguuggucgaacccg

SEQ ID NO: 2843 - RNA, 20 nt, Homo sapiens
ugaauguuggucgaacccgu

SEQ ID NO: 2844 - RNA, 20 nt, Homo sapiens
gaauguuggucgaacccgua

SEQ ID NO: 2845 - RNA, 20 nt, Homo sapiens
aauguuggucgaacccguaa

SEQ ID NO: 2846 - RNA, 20 nt, Homo sapiens
auguuggucgaacccguaac

SEQ ID NO: 2847 - RNA, 20 nt, Homo sapiens
uguuggucgaacccguaacu

SEQ ID NO: 2848 - RNA, 20 nt, Homo sapiens
guuggucgaacccguaacug

SEQ ID NO: 2849 - RNA, 20 nt, Homo sapiens
uuggucgaacccguaacugc

SEQ ID NO: 2850 - RNA, 20 nt, Homo sapiens
uggucgaacccguaacugcu

SEQ ID NO: 2851 - RNA, 20 nt, Homo sapiens
ggucgaacccguaacugcuu

SEQ ID NO: 2852 - RNA, 20 nt, Homo sapiens
gucgaacccguaacugcuua

SEQ ID NO: 2853 - RNA, 20 nt, Homo sapiens
ucgaacccguaacugcuuag

SEQ ID NO: 2854 - RNA, 20 nt, Homo sapiens
cgaacccguaacugcuuagg

SEQ ID NO: 2855 - RNA, 20 nt, Homo sapiens
gaacccguaacugcuuagga

SEQ ID NO: 2856 - RNA, 20 nt, Homo sapiens
aacccguaacugcuuaggag

SEQ ID NO: 2857 - RNA, 20 nt, Homo sapiens
acccguaacugcuuaggagc

SEQ ID NO: 2858 - RNA, 20 nt, Homo sapiens
cccguaacugcuuaggagcu

SEQ ID NO: 2859 - RNA, 20 nt, Homo sapiens
ccguaacugcuuaggagcug

SEQ ID NO: 2860 - RNA, 20 nt, Homo sapiens
cguaacugcuuaggagcugg

SEQ ID NO: 2861 - RNA, 20 nt, Homo sapiens
guaacugcuuaggagcugga

SEQ ID NO: 2862 - RNA, 20 nt, Homo sapiens
uaacugcuuaggagcuggaa

SEQ ID NO: 2863 - RNA, 20 nt, Homo sapiens
aacugcuuaggagcuggaag

SEQ ID NO: 2864 - RNA, 20 nt, Homo sapiens
acugcuuaggagcuggaaga

SEQ ID NO: 2865 - RNA, 20 nt, Homo sapiens
cugcuuaggagcuggaagag

SEQ ID NO: 2866 - RNA, 20 nt, Homo sapiens
ugcuuaggagcuggaagagu

SEQ ID NO: 2867 - RNA, 20 nt, Homo sapiens
gcuuaggagcuggaagaguu

SEQ ID NO: 2868 - RNA, 20 nt, Homo sapiens
cuuaggagcuggaagaguuu

SEQ ID NO: 2869 - RNA, 20 nt, Homo sapiens
uuaggagcuggaagaguuug

SEQ ID NO: 2870 - RNA, 20 nt, Homo sapiens
uaggagcuggaagaguuugg

SEQ ID NO: 2871 - RNA, 20 nt, Homo sapiens
aggagcuggaagaguuuggu

SEQ ID NO: 2872 - RNA, 20 nt, Homo sapiens
ggagcuggaagaguuugguu

SEQ ID NO: 2873 - RNA, 20 nt, Homo sapiens
gagcuggaagaguuugguuu

SEQ ID NO: 2874 - RNA, 20 nt, Homo sapiens
agcuggaagaguuugguuug

SEQ ID NO: 2875 - RNA, 20 nt, Homo sapiens
gcuggaagaguuugguuugg

SEQ ID NO: 2876 - RNA, 20 nt, Homo sapiens
cuggaagaguuugguuugga

SEQ ID NO: 2877 - RNA, 20 nt, Homo sapiens
uggaagaguuugguuuggac

SEQ ID NO: 2878 - RNA, 20 nt, Homo sapiens
ggaagaguuugguuuggacg

SEQ ID NO: 2879 - RNA, 20 nt, Homo sapiens
gaagaguuugguuuggacgu

SEQ ID NO: 2880 - RNA, 20 nt, Homo sapiens
aagaguuugguuuggacgug

SEQ ID NO: 2881 - RNA, 20 nt, Homo sapiens
agaguuugguuuggacgugc

SEQ ID NO: 2882 - RNA, 20 nt, Homo sapiens
gaguuugguuuggacgugcc

SEQ ID NO: 2883 - RNA, 20 nt, Homo sapiens
aguuugguuuggacgugccg

SEQ ID NO: 2884 - RNA, 20 nt, Homo sapiens
guuugguuuggacgugccgu

SEQ ID NO: 2885 - RNA, 20 nt, Homo sapiens
uuugguuuggacgugccgua

SEQ ID NO: 2886 - RNA, 20 nt, Homo sapiens
uugguuuggacgugccguaa

SEQ ID NO: 2887 - RNA, 20 nt, Homo sapiens
ugguuuggacgugccguaac

SEQ ID NO: 2888 - RNA, 20 nt, Homo sapiens
gguuuggacgugccguaacg

SEQ ID NO: 2889 - RNA, 20 nt, Homo sapiens
guuuggacgugccguaacgu

SEQ ID NO: 2890 - RNA, 20 nt, Homo sapiens
uuuggacgugccguaacguc

SEQ ID NO: 2891 - RNA, 20 nt, Homo sapiens
uuggacgugccguaacgucu

SEQ ID NO: 2892 - RNA, 20 nt, Homo sapiens
uggacgugccguaacgucua

SEQ ID NO: 2893 - RNA, 20 nt, Homo sapiens
ggacgugccguaacgucuaa

SEQ ID NO: 2894 - RNA, 20 nt, Homo sapiens
gacgugccguaacgucuaau

SEQ ID NO: 2895 - RNA, 20 nt, Homo sapiens
acgugccguaacgucuaauc

SEQ ID NO: 2896 - RNA, 20 nt, Homo sapiens
cgugccguaacgucuaaucu

SEQ ID NO: 2897 - RNA, 20 nt, Homo sapiens
gugccguaacgucuaaucuu

SEQ ID NO: 2898 - RNA, 20 nt, Homo sapiens
ugccguaacgucuaaucuug

SEQ ID NO: 2899 - RNA, 20 nt, Homo sapiens
gccguaacgucuaaucuugu

SEQ ID NO: 2900 - RNA, 20 nt, Homo sapiens
ccguaacgucuaaucuugug

SEQ ID NO: 2901 - RNA, 20 nt, Homo sapiens
cguaacgucuaaucuugugu

SEQ ID NO: 2902 - RNA, 20 nt, Homo sapiens
guaacgucuaaucuuguguu

SEQ ID NO: 2903 - RNA, 20 nt, Homo sapiens
uaacgucuaaucuuguguua

SEQ ID NO: 2904 - RNA, 20 nt, Homo sapiens
aacgucuaaucuuguguuac

SEQ ID NO: 2905 - RNA, 20 nt, Homo sapiens
acgucuaaucuuguguuaca

SEQ ID NO: 2906 - RNA, 20 nt, Homo sapiens
cgucuaaucuuguguuacau

SEQ ID NO: 2907 - RNA, 20 nt, Homo sapiens
gucuaaucuuguguuacaug

SEQ ID NO: 2908 - RNA, 20 nt, Homo sapiens
ucuaaucuuguguuacaugu

SEQ ID NO: 2909 - RNA, 20 nt, Homo sapiens
cuaaucuuguguuacaugua

SEQ ID NO: 2910 - RNA, 20 nt, Homo sapiens
uaaucuuguguuacauguag

SEQ ID NO: 2911 - RNA, 20 nt, Homo sapiens
aaucuuguguuacauguagu

SEQ ID NO: 2912 - RNA, 20 nt, Homo sapiens
aucuuguguuacauguaguc

SEQ ID NO: 2913 - RNA, 20 nt, Homo sapiens
ucuuguguuacauguaguca

SEQ ID NO: 2914 - RNA, 20 nt, Homo sapiens
cuuguguuacauguagucac

SEQ ID NO: 2915 - RNA, 20 nt, Homo sapiens
uuguguuacauguagucacu

SEQ ID NO: 2916 - RNA, 20 nt, Homo sapiens
uguguuacauguagucacuc

SEQ ID NO: 2917 - RNA, 20 nt, Homo sapiens
guguuacauguagucacucc

SEQ ID NO: 2918 - RNA, 20 nt, Homo sapiens
uguuacauguagucacucca

SEQ ID NO: 2919 - RNA, 20 nt, Homo sapiens
guuacauguagucacuccag

SEQ ID NO: 2920 - RNA, 20 nt, Homo sapiens
uuacauguagucacuccagc

SEQ ID NO: 2921 - RNA, 20 nt, Homo sapiens
uacauguagucacuccagcu

SEQ ID NO: 2922 - RNA, 20 nt, Homo sapiens
acauguagucacuccagcuu

SEQ ID NO: 2923 - RNA, 20 nt, Homo sapiens
cauguagucacuccagcuuc

SEQ ID NO: 2924 - RNA, 20 nt, Homo sapiens
auguagucacuccagcuuca

SEQ ID NO: 2925 - RNA, 20 nt, Homo sapiens
uguagucacuccagcuucau

SEQ ID NO: 2926 - RNA, 20 nt, Homo sapiens
guagucacuccagcuucauu

SEQ ID NO: 2927 - RNA, 20 nt, Homo sapiens
uagucacuccagcuucauua

SEQ ID NO: 2928 - RNA, 20 nt, Homo sapiens
agucacuccagcuucauuaa

SEQ ID NO: 2929 - RNA, 20 nt, Homo sapiens
gucacuccagcuucauuaac

SEQ ID NO: 2930 - RNA, 20 nt, Homo sapiens
ucacuccagcuucauuaacu

SEQ ID NO: 2931 - RNA, 20 nt, Homo sapiens
cacuccagcuucauuaacug

SEQ ID NO: 2932 - RNA, 20 nt, Homo sapiens
acuccagcuucauuaacugc

SEQ ID NO: 2933 - RNA, 20 nt, Homo sapiens
cuccagcuucauuaacugcu

SEQ ID NO: 2934 - RNA, 20 nt, Homo sapiens
uccagcuucauuaacugcug

SEQ ID NO: 2935 - RNA, 20 nt, Homo sapiens
ccagcuucauuaacugcuga

SEQ ID NO: 2936 - RNA, 20 nt, Homo sapiens
cagcuucauuaacugcugac

SEQ ID NO: 2937 - RNA, 20 nt, Homo sapiens
agcuucauuaacugcugaca

SEQ ID NO: 2938 - RNA, 20 nt, Homo sapiens
gcuucauuaacugcugacac

SEQ ID NO: 2939 - RNA, 20 nt, Homo sapiens
cuucauuaacugcugacaca

SEQ ID NO: 2940 - RNA, 20 nt, Homo sapiens
uucauuaacugcugacacag

SEQ ID NO: 2941 - RNA, 20 nt, Homo sapiens
ucauuaacugcugacacagu

SEQ ID NO: 2942 - RNA, 20 nt, Homo sapiens
cauuaacugcugacacagua

SEQ ID NO: 2943 - RNA, 20 nt, Homo sapiens
auuaacugcugacacaguau

SEQ ID NO: 2944 - RNA, 20 nt, Homo sapiens
uuaacugcugacacaguaua

SEQ ID NO: 2945 - RNA, 20 nt, Homo sapiens
uaacugcugacacaguauac

SEQ ID NO: 2946 - RNA, 20 nt, Homo sapiens
aacugcugacacaguauacc

SEQ ID NO: 2947 - RNA, 20 nt, Homo sapiens
acugcugacacaguauacca

SEQ ID NO: 2948 - RNA, 20 nt, Homo sapiens
cugcugacacaguauaccac

SEQ ID NO: 2949 - RNA, 20 nt, Homo sapiens
ugcugacacaguauaccacc

SEQ ID NO: 2950 - RNA, 20 nt, Homo sapiens
gcugacacaguauaccaccc

SEQ ID NO: 2951 - RNA, 20 nt, Homo sapiens
cugacacaguauaccaccca

SEQ ID NO: 2952 - RNA, 20 nt, Homo sapiens
ugacacaguauaccacccag

SEQ ID NO: 2953 - RNA, 20 nt, Homo sapiens
gacacaguauaccacccagc

SEQ ID NO: 2954 - RNA, 20 nt, Homo sapiens
acacaguauaccacccagca

SEQ ID NO: 2955 - RNA, 20 nt, Homo sapiens
cacaguauaccacccagcau

SEQ ID NO: 2956 - RNA, 20 nt, Homo sapiens
acaguauaccacccagcauc

SEQ ID NO: 2957 - RNA, 20 nt, Homo sapiens
caguauaccacccagcaucu

SEQ ID NO: 2958 - RNA, 20 nt, Homo sapiens
aguauaccacccagcaucuu

SEQ ID NO: 2959 - RNA, 20 nt, Homo sapiens
guauaccacccagcaucuuu

SEQ ID NO: 2960 - RNA, 20 nt, Homo sapiens
uauaccacccagcaucuuuc

SEQ ID NO: 2961 - RNA, 20 nt, Homo sapiens
auaccacccagcaucuuucu

SEQ ID NO: 2962 - RNA, 20 nt, Homo sapiens
uaccacccagcaucuuucuu

SEQ ID NO: 2963 - RNA, 20 nt, Homo sapiens
accacccagcaucuuucuug

SEQ ID NO: 2964 - RNA, 20 nt, Homo sapiens
ccacccagcaucuuucuugu

SEQ ID NO: 2965 - RNA, 20 nt, Homo sapiens
cacccagcaucuuucuuguu

SEQ ID NO: 2966 - RNA, 20 nt, Homo sapiens
acccagcaucuuucuuguuu

SEQ ID NO: 2967 - RNA, 20 nt, Homo sapiens
cccagcaucuuucuuguuua

SEQ ID NO: 2968 - RNA, 20 nt, Homo sapiens
ccagcaucuuucuuguuuac

SEQ ID NO: 2969 - RNA, 20 nt, Homo sapiens
cagcaucuuucuuguuuaca

SEQ ID NO: 2970 - RNA, 20 nt, Homo sapiens
agcaucuuucuuguuuacau

SEQ ID NO: 2971 - RNA, 20 nt, Homo sapiens
gcaucuuucuuguuuacauc

SEQ ID NO: 2972 - RNA, 20 nt, Homo sapiens
caucuuucuuguuuacaucu

SEQ ID NO: 2973 - RNA, 20 nt, Homo sapiens
aucuuucuuguuuacaucuu

SEQ ID NO: 2974 - RNA, 20 nt, Homo sapiens
ucuuucuuguuuacaucuuu

SEQ ID NO: 2975 - RNA, 20 nt, Homo sapiens
cuuucuuguuuacaucuuuu

SEQ ID NO: 2976 - RNA, 20 nt, Homo sapiens
uuucuuguuuacaucuuuua

SEQ ID NO: 2977 - RNA, 20 nt, Homo sapiens
uucuuguuuacaucuuuuau

SEQ ID NO: 2978 - RNA, 20 nt, Homo sapiens
ucuuguuuacaucuuuuauc

SEQ ID NO: 2979 - RNA, 20 nt, Homo sapiens
cuuguuuacaucuuuuauca

SEQ ID NO: 2980 - RNA, 20 nt, Homo sapiens
uuguuuacaucuuuuaucag

SEQ ID NO: 2981 - RNA, 20 nt, Homo sapiens
uguuuacaucuuuuaucagu

SEQ ID NO: 2982 - RNA, 20 nt, Homo sapiens
guuuacaucuuuuaucagua

SEQ ID NO: 2983 - RNA, 20 nt, Homo sapiens
uuuacaucuuuuaucaguaa

SEQ ID NO: 2984 - RNA, 20 nt, Homo sapiens
uuacaucuuuuaucaguaaa

SEQ ID NO: 2985 - RNA, 20 nt, Homo sapiens
uacaucuuuuaucaguaaag

SEQ ID NO: 2986 - RNA, 20 nt, Homo sapiens
acaucuuuuaucaguaaagu

SEQ ID NO: 2987 - RNA, 20 nt, Homo sapiens
caucuuuuaucaguaaagua

SEQ ID NO: 2988 - RNA, 20 nt, Homo sapiens
aucuuuuaucaguaaaguaa

SEQ ID NO: 2989 - RNA, 20 nt, Homo sapiens
ucuuuuaucaguaaaguaac

SEQ ID NO: 2990 - RNA, 20 nt, Homo sapiens
cuuuuaucaguaaaguaacu

SEQ ID NO: 2991 - RNA, 20 nt, Homo sapiens
uuuuaucaguaaaguaacuc

SEQ ID NO: 2992 - RNA, 20 nt, Homo sapiens
uuuaucaguaaaguaacucu

SEQ ID NO: 2993 - RNA, 20 nt, Homo sapiens
uuaucaguaaaguaacucuu

SEQ ID NO: 2994 - RNA, 20 nt, Homo sapiens
uaucaguaaaguaacucuuc

SEQ ID NO: 2995 - RNA, 20 nt, Homo sapiens
aucaguaaaguaacucuucc

SEQ ID NO: 2996 - RNA, 20 nt, Homo sapiens
ucaguaaaguaacucuucca

SEQ ID NO: 2997 - RNA, 20 nt, Homo sapiens
caguaaaguaacucuuccag

SEQ ID NO: 2998 - RNA, 20 nt, Homo sapiens
aguaaaguaacucuuccagu

SEQ ID NO: 2999 - RNA, 20 nt, Homo sapiens
guaaaguaacucuuccagug

SEQ ID NO: 3000 - RNA, 20 nt, Homo sapiens
uaaaguaacucuuccagugu

SEQ ID NO: 3001 - RNA, 20 nt, Homo sapiens
aaaguaacucuuccaguguu

SEQ ID NO: 3002 - RNA, 20 nt, Homo sapiens
aaguaacucuuccaguguua

SEQ ID NO: 3003 - RNA, 20 nt, Homo sapiens
aguaacucuuccaguguuau

SEQ ID NO: 3004 - RNA, 20 nt, Homo sapiens
guaacucuuccaguguuauc

SEQ ID NO: 3005 - RNA, 20 nt, Homo sapiens
uaacucuuccaguguuaucu

SEQ ID NO: 3006 - RNA, 20 nt, Homo sapiens
aacucuuccaguguuaucuu

SEQ ID NO: 3007 - RNA, 20 nt, Homo sapiens
acucuuccaguguuaucuug

SEQ ID NO: 3008 - RNA, 20 nt, Homo sapiens
cucuuccaguguuaucuuga

SEQ ID NO: 3009 - RNA, 20 nt, Homo sapiens
ucuuccaguguuaucuugau

SEQ ID NO: 3010 - RNA, 20 nt, Homo sapiens
cuuccaguguuaucuugaua

SEQ ID NO: 3011 - RNA, 20 nt, Homo sapiens
uuccaguguuaucuugauau

SEQ ID NO: 3012 - RNA, 20 nt, Homo sapiens
uccaguguuaucuugauaua

SEQ ID NO: 3013 - RNA, 20 nt, Homo sapiens
ccaguguuaucuugauauaa

SEQ ID NO: 3014 - RNA, 20 nt, Homo sapiens
caguguuaucuugauauaag

SEQ ID NO: 3015 - RNA, 20 nt, Homo sapiens
aguguuaucuugauauaagc

SEQ ID NO: 3016 - RNA, 20 nt, Homo sapiens
guguuaucuugauauaagcu

SEQ ID NO: 3017 - RNA, 20 nt, Homo sapiens
uguuaucuugauauaagcuu

SEQ ID NO: 3018 - RNA, 20 nt, Homo sapiens
guuaucuugauauaagcuua

SEQ ID NO: 3019 - RNA, 20 nt, Homo sapiens
uuaucuugauauaagcuuau

SEQ ID NO: 3020 - RNA, 20 nt, Homo sapiens
uaucuugauauaagcuuauu

SEQ ID NO: 3021 - RNA, 20 nt, Homo sapiens
aucuugauauaagcuuauuc

SEQ ID NO: 3022 - RNA, 20 nt, Homo sapiens
ucuugauauaagcuuauucg

SEQ ID NO: 3023 - RNA, 20 nt, Homo sapiens
cuugauauaagcuuauucgg

SEQ ID NO: 3024 - RNA, 20 nt, Homo sapiens
uugauauaagcuuauucggu

SEQ ID NO: 3025 - RNA, 20 nt, Homo sapiens
ugauauaagcuuauucgguc

SEQ ID NO: 3026 - RNA, 20 nt, Homo sapiens
gauauaagcuuauucgguca

SEQ ID NO: 3027 - RNA, 20 nt, Homo sapiens
auauaagcuuauucggucag

SEQ ID NO: 3028 - RNA, 20 nt, Homo sapiens
uauaagcuuauucggucagu

SEQ ID NO: 3029 - RNA, 20 nt, Homo sapiens
auaagcuuauucggucagug

SEQ ID NO: 3030 - RNA, 20 nt, Homo sapiens
uaagcuuauucggucagugu

SEQ ID NO: 3031 - RNA, 20 nt, Homo sapiens
aagcuuauucggucaguguu

SEQ ID NO: 3032 - RNA, 20 nt, Homo sapiens
agcuuauucggucaguguug

SEQ ID NO: 3033 - RNA, 20 nt, Homo sapiens
gcuuauucggucaguguuga

SEQ ID NO: 3034 - RNA, 20 nt, Homo sapiens
cuuauucggucaguguugaa

SEQ ID NO: 3035 - RNA, 20 nt, Homo sapiens
uuauucggucaguguugaau

SEQ ID NO: 3036 - RNA, 20 nt, Homo sapiens
uauucggucaguguugaauu

SEQ ID NO: 3037 - RNA, 20 nt, Homo sapiens
auucggucaguguugaauug

SEQ ID NO: 3038 - RNA, 20 nt, Homo sapiens
uucggucaguguugaauugu

SEQ ID NO: 3039 - RNA, 20 nt, Homo sapiens
ucggucaguguugaauugua

SEQ ID NO: 3040 - RNA, 20 nt, Homo sapiens
cggucaguguugaauuguac

SEQ ID NO: 3041 - RNA, 20 nt, Homo sapiens
ggucaguguugaauuguacc

SEQ ID NO: 3042 - RNA, 20 nt, Homo sapiens
gucaguguugaauuguacca

SEQ ID NO: 3043 - RNA, 20 nt, Homo sapiens
ucaguguugaauuguaccau

SEQ ID NO: 3044 - RNA, 20 nt, Homo sapiens
caguguugaauuguaccauu

SEQ ID NO: 3045 - RNA, 20 nt, Homo sapiens
aguguugaauuguaccauuu

SEQ ID NO: 3046 - RNA, 20 nt, Homo sapiens
guguugaauuguaccauuuc

SEQ ID NO: 3047 - RNA, 20 nt, Homo sapiens
uguugaauuguaccauuuca

SEQ ID NO: 3048 - RNA, 20 nt, Homo sapiens
guugaauuguaccauuucau

SEQ ID NO: 3049 - RNA, 20 nt, Homo sapiens
uugaauuguaccauuucauu

SEQ ID NO: 3050 - RNA, 20 nt, Homo sapiens
ugaauuguaccauuucauua

SEQ ID NO: 3051 - RNA, 20 nt, Homo sapiens
gaauuguaccauuucauuau

SEQ ID NO: 3052 - RNA, 20 nt, Homo sapiens
aauuguaccauuucauuauu

SEQ ID NO: 3053 - RNA, 20 nt, Homo sapiens
auuguaccauuucauuauuu

SEQ ID NO: 3054 - RNA, 20 nt, Homo sapiens
uuguaccauuucauuauuuc

SEQ ID NO: 3055 - RNA, 20 nt, Homo sapiens
uguaccauuucauuauuucu

SEQ ID NO: 3056 - RNA, 20 nt, Homo sapiens
guaccauuucauuauuucuu

SEQ ID NO: 3057 - RNA, 20 nt, Homo sapiens
uaccauuucauuauuucuuu

SEQ ID NO: 3058 - RNA, 20 nt, Homo sapiens
accauuucauuauuucuuuu

SEQ ID NO: 3059 - RNA, 20 nt, Homo sapiens
ccauuucauuauuucuuuuc

SEQ ID NO: 3060 - RNA, 20 nt, Homo sapiens
cauuucauuauuucuuuucc

SEQ ID NO: 3061 - RNA, 20 nt, Homo sapiens
auuucauuauuucuuuucca

SEQ ID NO: 3062 - RNA, 20 nt, Homo sapiens
uuucauuauuucuuuuccag

SEQ ID NO: 3063 - RNA, 20 nt, Homo sapiens
uucauuauuucuuuuccaga

SEQ ID NO: 3064 - RNA, 20 nt, Homo sapiens
ucauuauuucuuuuccagaa

SEQ ID NO: 3065 - RNA, 20 nt, Homo sapiens
cauuauuucuuuuccagaaa

SEQ ID NO: 3066 - RNA, 20 nt, Homo sapiens
auuauuucuuuuccagaaaa

SEQ ID NO: 3067 - RNA, 20 nt, Homo sapiens
uuauuucuuuuccagaaaag

SEQ ID NO: 3068 - RNA, 20 nt, Homo sapiens
uauuucuuuuccagaaaagc

SEQ ID NO: 3069 - RNA, 20 nt, Homo sapiens
auuucuuuuccagaaaagcu

SEQ ID NO: 3070 - RNA, 20 nt, Homo sapiens
uuucuuuuccagaaaagcuu

SEQ ID NO: 3071 - RNA, 20 nt, Homo sapiens
uucuuuuccagaaaagcuuu

SEQ ID NO: 3072 - RNA, 20 nt, Homo sapiens
ucuuuuccagaaaagcuuug

SEQ ID NO: 3073 - RNA, 20 nt, Homo sapiens
cuuuuccagaaaagcuuugg

SEQ ID NO: 3074 - RNA, 20 nt, Homo sapiens
uuuuccagaaaagcuuuggu

SEQ ID NO: 3075 - RNA, 20 nt, Homo sapiens
uuuccagaaaagcuuuggug

SEQ ID NO: 3076 - RNA, 20 nt, Homo sapiens
uuccagaaaagcuuuggugg

SEQ ID NO: 3077 - RNA, 20 nt, Homo sapiens
uccagaaaagcuuuggugga

SEQ ID NO: 3078 - RNA, 20 nt, Homo sapiens
ccagaaaagcuuugguggag

SEQ ID NO: 3079 - RNA, 20 nt, Homo sapiens
cagaaaagcuuugguggagg

SEQ ID NO: 3080 - RNA, 20 nt, Homo sapiens
agaaaagcuuugguggaggu

SEQ ID NO: 3081 - RNA, 20 nt, Homo sapiens
gaaaagcuuugguggaggua

SEQ ID NO: 3082 - RNA, 20 nt, Homo sapiens
aaaagcuuugguggagguau

SEQ ID NO: 3083 - RNA, 20 nt, Homo sapiens
aaagcuuugguggagguaua

SEQ ID NO: 3084 - RNA, 20 nt, Homo sapiens
aagcuuugguggagguauag

SEQ ID NO: 3085 - RNA, 20 nt, Homo sapiens
agcuuugguggagguauagc

SEQ ID NO: 3086 - RNA, 20 nt, Homo sapiens
gcuuugguggagguauagcc

SEQ ID NO: 3087 - RNA, 20 nt, Homo sapiens
cuuugguggagguauagccg

SEQ ID NO: 3088 - RNA, 20 nt, Homo sapiens
uuugguggagguauagccga

SEQ ID NO: 3089 - RNA, 20 nt, Homo sapiens
uugguggagguauagccgag

SEQ ID NO: 3090 - RNA, 20 nt, Homo sapiens
ugguggagguauagccgaga

SEQ ID NO: 3091 - RNA, 20 nt, Homo sapiens
gguggagguauagccgagau

SEQ ID NO: 3092 - RNA, 20 nt, Homo sapiens
guggagguauagccgagauc

SEQ ID NO: 3093 - RNA, 20 nt, Homo sapiens
uggagguauagccgagaucu

SEQ ID NO: 3094 - RNA, 20 nt, Homo sapiens
ggagguauagccgagaucug

SEQ ID NO: 3095 - RNA, 20 nt, Homo sapiens
gagguauagccgagaucugg

SEQ ID NO: 3096 - RNA, 20 nt, Homo sapiens
agguauagccgagaucuggc

SEQ ID NO: 3097 - RNA, 20 nt, Homo sapiens
gguauagccgagaucuggca

SEQ ID NO: 3098 - RNA, 20 nt, Homo sapiens
guauagccgagaucuggcau

SEQ ID NO: 3099 - RNA, 20 nt, Homo sapiens
uauagccgagaucuggcauu

SEQ ID NO: 3100 - RNA, 20 nt, Homo sapiens
auagccgagaucuggcauuc

SEQ ID NO: 3101 - RNA, 20 nt, Homo sapiens
uagccgagaucuggcauucu

SEQ ID NO: 3102 - RNA, 20 nt, Homo sapiens
agccgagaucuggcauucua

SEQ ID NO: 3103 - RNA, 20 nt, Homo sapiens
gccgagaucuggcauucuag

SEQ ID NO: 3104 - RNA, 20 nt, Homo sapiens
ccgagaucuggcauucuagu

SEQ ID NO: 3105 - RNA, 20 nt, Homo sapiens
cgagaucuggcauucuaguu

SEQ ID NO: 3106 - RNA, 20 nt, Homo sapiens
gagaucuggcauucuaguuu

SEQ ID NO: 3107 - RNA, 20 nt, Homo sapiens
agaucuggcauucuaguuuc

SEQ ID NO: 3108 - RNA, 20 nt, Homo sapiens
gaucuggcauucuaguuuca

SEQ ID NO: 3109 - RNA, 20 nt, Homo sapiens
aucuggcauucuaguuucac

SEQ ID NO: 3110 - RNA, 20 nt, Homo sapiens
ucuggcauucuaguuucacu

SEQ ID NO: 3111 - RNA, 20 nt, Homo sapiens
cuggcauucuaguuucacug

SEQ ID NO: 3112 - RNA, 20 nt, Homo sapiens
uggcauucuaguuucacuga

SEQ ID NO: 3113 - RNA, 20 nt, Homo sapiens
ggcauucuaguuucacugaa

SEQ ID NO: 3114 - RNA, 20 nt, Homo sapiens
gcauucuaguuucacugaau

SEQ ID NO: 3115 - RNA, 20 nt, Homo sapiens
cauucuaguuucacugaauc

SEQ ID NO: 3116 - RNA, 20 nt, Homo sapiens
auucuaguuucacugaaucu

SEQ ID NO: 3117 - RNA, 20 nt, Homo sapiens
uucuaguuucacugaaucuc

SEQ ID NO: 3118 - RNA, 20 nt, Homo sapiens
ucuaguuucacugaaucucc

SEQ ID NO: 3119 - RNA, 20 nt, Homo sapiens
cuaguuucacugaaucuccc

SEQ ID NO: 3120 - RNA, 20 nt, Homo sapiens
uaguuucacugaaucucccu

SEQ ID NO: 3121 - RNA, 20 nt, Homo sapiens
aguuucacugaaucucccuc

SEQ ID NO: 3122 - RNA, 20 nt, Homo sapiens
guuucacugaaucucccucu

SEQ ID NO: 3123 - RNA, 20 nt, Homo sapiens
uuucacugaaucucccucua

SEQ ID NO: 3124 - RNA, 20 nt, Homo sapiens
uucacugaaucucccucuaa

SEQ ID NO: 3125 - RNA, 20 nt, Homo sapiens
ucacugaaucucccucuaaa

SEQ ID NO: 3126 - RNA, 20 nt, Homo sapiens
cacugaaucucccucuaaaa

SEQ ID NO: 3127 - RNA, 20 nt, Homo sapiens
acugaaucucccucuaaaac

SEQ ID NO: 3128 - RNA, 20 nt, Homo sapiens
cugaaucucccucuaaaacu

SEQ ID NO: 3129 - RNA, 20 nt, Homo sapiens
ugaaucucccucuaaaacuu

SEQ ID NO: 3130 - RNA, 20 nt, Homo sapiens
gaaucucccucuaaaacuuu

SEQ ID NO: 3131 - RNA, 20 nt, Homo sapiens
aaucucccucuaaaacuuuu

SEQ ID NO: 3132 - RNA, 20 nt, Homo sapiens
aucucccucuaaaacuuuuu

SEQ ID NO: 3133 - RNA, 20 nt, Homo sapiens
ucucccucuaaaacuuuuuu

SEQ ID NO: 3134 - RNA, 20 nt, Homo sapiens
cucccucuaaaacuuuuuug

SEQ ID NO: 3135 - RNA, 20 nt, Homo sapiens
ucccucuaaaacuuuuuugc

SEQ ID NO: 3136 - RNA, 20 nt, Homo sapiens
cccucuaaaacuuuuuugcu

SEQ ID NO: 3137 - RNA, 20 nt, Homo sapiens
ccucuaaaacuuuuuugcuc

SEQ ID NO: 3138 - RNA, 20 nt, Homo sapiens
cucuaaaacuuuuuugcucu

SEQ ID NO: 3139 - RNA, 20 nt, Homo sapiens
ucuaaaacuuuuuugcucug

SEQ ID NO: 3140 - RNA, 20 nt, Homo sapiens
cuaaaacuuuuuugcucugu

SEQ ID NO: 3141 - RNA, 20 nt, Homo sapiens
uaaaacuuuuuugcucugug

SEQ ID NO: 3142 - RNA, 20 nt, Homo sapiens
aaaacuuuuuugcucugugg

SEQ ID NO: 3143 - RNA, 20 nt, Homo sapiens
aaacuuuuuugcucuguggu

SEQ ID NO: 3144 - RNA, 20 nt, Homo sapiens
aacuuuuuugcucugugguu

SEQ ID NO: 3145 - RNA, 20 nt, Homo sapiens
acuuuuuugcucugugguuu

SEQ ID NO: 3146 - RNA, 20 nt, Homo sapiens
cuuuuuugcucugugguuug

SEQ ID NO: 3147 - RNA, 20 nt, Homo sapiens
uuuuuugcucugugguuugu

SEQ ID NO: 3148 - RNA, 20 nt, Homo sapiens
uuuuugcucugugguuugua

SEQ ID NO: 3149 - RNA, 20 nt, Homo sapiens
uuuugcucugugguuuguag

SEQ ID NO: 3150 - RNA, 20 nt, Homo sapiens
uuugcucugugguuuguaga

SEQ ID NO: 3151 - RNA, 20 nt, Homo sapiens
uugcucugugguuuguagau

SEQ ID NO: 3152 - RNA, 20 nt, Homo sapiens
ugcucugugguuuguagaua

SEQ ID NO: 3153 - RNA, 20 nt, Homo sapiens
gcucugugguuuguagauaa

SEQ ID NO: 3154 - RNA, 20 nt, Homo sapiens
cucugugguuuguagauaaa

SEQ ID NO: 3155 - RNA, 20 nt, Homo sapiens
ucugugguuuguagauaaac

SEQ ID NO: 3156 - RNA, 20 nt, Homo sapiens
cugugguuuguagauaaaca

SEQ ID NO: 3157 - RNA, 20 nt, Homo sapiens
ugugguuuguagauaaacau

SEQ ID NO: 3158 - RNA, 20 nt, Homo sapiens
gugguuuguagauaaacauu

SEQ ID NO: 3159 - RNA, 20 nt, Homo sapiens
ugguuuguagauaaacauug

SEQ ID NO: 3160 - RNA, 20 nt, Homo sapiens
gguuuguagauaaacauugg

SEQ ID NO: 3161 - RNA, 20 nt, Homo sapiens
guuuguagauaaacauuggu

SEQ ID NO: 3162 - RNA, 20 nt, Homo sapiens
uuuguagauaaacauuggug

SEQ ID NO: 3163 - RNA, 20 nt, Homo sapiens
uuguagauaaacauuggugc

SEQ ID NO: 3164 - RNA, 20 nt, Homo sapiens
uguagauaaacauuggugcu

SEQ ID NO: 3165 - RNA, 20 nt, Homo sapiens
guagauaaacauuggugcuc

SEQ ID NO: 3166 - RNA, 20 nt, Homo sapiens
uagauaaacauuggugcucu

SEQ ID NO: 3167 - RNA, 20 nt, Homo sapiens
agauaaacauuggugcucuu

SEQ ID NO: 3168 - RNA, 20 nt, Homo sapiens
gauaaacauuggugcucuuu

SEQ ID NO: 3169 - RNA, 20 nt, Homo sapiens
auaaacauuggugcucuuuu

SEQ ID NO: 3170 - RNA, 20 nt, Homo sapiens
uaaacauuggugcucuuuua

SEQ ID NO: 3171 - RNA, 20 nt, Homo sapiens
aaacauuggugcucuuuuau

SEQ ID NO: 3172 - RNA, 20 nt, Homo sapiens
aacauuggugcucuuuuaug

SEQ ID NO: 3173 - RNA, 20 nt, Homo sapiens
acauuggugcucuuuuaugu

SEQ ID NO: 3174 - RNA, 20 nt, Homo sapiens
cauuggugcucuuuuauguu

SEQ ID NO: 3175 - RNA, 20 nt, Homo sapiens
auuggugcucuuuuauguuc

SEQ ID NO: 3176 - RNA, 20 nt, Homo sapiens
uuggugcucuuuuauguucu

SEQ ID NO: 3177 - RNA, 20 nt, Homo sapiens
uggugcucuuuuauguucuu

SEQ ID NO: 3178 - RNA, 20 nt, Homo sapiens
ggugcucuuuuauguucuuu

SEQ ID NO: 3179 - RNA, 20 nt, Homo sapiens
gugcucuuuuauguucuuuu

SEQ ID NO: 3180 - RNA, 20 nt, Homo sapiens
ugcucuuuuauguucuuuug

SEQ ID NO: 3181 - RNA, 20 nt, Homo sapiens
gcucuuuuauguucuuuugc

SEQ ID NO: 3182 - RNA, 20 nt, Homo sapiens
cucuuuuauguucuuuugca

SEQ ID NO: 3183 - RNA, 20 nt, Homo sapiens
ucuuuuauguucuuuugcaa

SEQ ID NO: 3184 - RNA, 20 nt, Homo sapiens
cuuuuauguucuuuugcaag

SEQ ID NO: 3185 - RNA, 20 nt, Homo sapiens
uuuuauguucuuuugcaagg

SEQ ID NO: 3186 - RNA, 20 nt, Homo sapiens
uuuauguucuuuugcaagga

SEQ ID NO: 3187 - RNA, 20 nt, Homo sapiens
uuauguucuuuugcaaggac

SEQ ID NO: 3188 - RNA, 20 nt, Homo sapiens
uauguucuuuugcaaggaca

SEQ ID NO: 3189 - RNA, 20 nt, Homo sapiens
auguucuuuugcaaggacau

SEQ ID NO: 3190 - RNA, 20 nt, Homo sapiens
uguucuuuugcaaggacauc

SEQ ID NO: 3191 - RNA, 20 nt, Homo sapiens
guucuuuugcaaggacaucc

SEQ ID NO: 3192 - RNA, 20 nt, Homo sapiens
uucuuuugcaaggacaucca

SEQ ID NO: 3193 - RNA, 20 nt, Homo sapiens
ucuuuugcaaggacauccag

SEQ ID NO: 3194 - RNA, 20 nt, Homo sapiens
cuuuugcaaggacauccagc

SEQ ID NO: 3195 - RNA, 20 nt, Homo sapiens
uuuugcaaggacauccagcu

SEQ ID NO: 3196 - RNA, 20 nt, Homo sapiens
uuugcaaggacauccagcug

SEQ ID NO: 3197 - RNA, 20 nt, Homo sapiens
uugcaaggacauccagcugc

SEQ ID NO: 3198 - RNA, 20 nt, Homo sapiens
ugcaaggacauccagcugca

SEQ ID NO: 3199 - RNA, 20 nt, Homo sapiens
gcaaggacauccagcugcac

SEQ ID NO: 3200 - RNA, 20 nt, Homo sapiens
caaggacauccagcugcaca

SEQ ID NO: 3201 - RNA, 20 nt, Homo sapiens
aaggacauccagcugcacag

SEQ ID NO: 3202 - RNA, 20 nt, Homo sapiens
aggacauccagcugcacagu

SEQ ID NO: 3203 - RNA, 20 nt, Homo sapiens
ggacauccagcugcacagug

SEQ ID NO: 3204 - RNA, 20 nt, Homo sapiens
gacauccagcugcacaguga

SEQ ID NO: 3205 - RNA, 20 nt, Homo sapiens
acauccagcugcacagugaa

SEQ ID NO: 3206 - RNA, 20 nt, Homo sapiens
cauccagcugcacagugaag

SEQ ID NO: 3207 - RNA, 20 nt, Homo sapiens
auccagcugcacagugaagg

SEQ ID NO: 3208 - RNA, 20 nt, Homo sapiens
uccagcugcacagugaaggu

SEQ ID NO: 3209 - RNA, 20 nt, Homo sapiens
ccagcugcacagugaaggug

SEQ ID NO: 3210 - RNA, 20 nt, Homo sapiens
cagcugcacagugaaggugg

SEQ ID NO: 3211 - RNA, 20 nt, Homo sapiens
agcugcacagugaagguggc

SEQ ID NO: 3212 - RNA, 20 nt, Homo sapiens
gcugcacagugaagguggcu

SEQ ID NO: 3213 - RNA, 20 nt, Homo sapiens
cugcacagugaagguggcuu

SEQ ID NO: 3214 - RNA, 20 nt, Homo sapiens
ugcacagugaagguggcuuc

SEQ ID NO: 3215 - RNA, 20 nt, Homo sapiens
gcacagugaagguggcuucu

SEQ ID NO: 3216 - RNA, 20 nt, Homo sapiens
cacagugaagguggcuucuc

SEQ ID NO: 3217 - RNA, 20 nt, Homo sapiens
acagugaagguggcuucucc

SEQ ID NO: 3218 - RNA, 20 nt, Homo sapiens
cagugaagguggcuucuccu

SEQ ID NO: 3219 - RNA, 20 nt, Homo sapiens
agugaagguggcuucuccug

SEQ ID NO: 3220 - RNA, 20 nt, Homo sapiens
gugaagguggcuucuccugc

SEQ ID NO: 3221 - RNA, 20 nt, Homo sapiens
ugaagguggcuucuccugcu

SEQ ID NO: 3222 - RNA, 20 nt, Homo sapiens
gaagguggcuucuccugcuc

SEQ ID NO: 3223 - RNA, 20 nt, Homo sapiens
aagguggcuucuccugcucu

SEQ ID NO: 3224 - RNA, 20 nt, Homo sapiens
agguggcuucuccugcucua

SEQ ID NO: 3225 - RNA, 20 nt, Homo sapiens
gguggcuucuccugcucuau

SEQ ID NO: 3226 - RNA, 20 nt, Homo sapiens
guggcuucuccugcucuauu

SEQ ID NO: 3227 - RNA, 20 nt, Homo sapiens
uggcuucuccugcucuauuc

SEQ ID NO: 3228 - RNA, 20 nt, Homo sapiens
ggcuucuccugcucuauucu

SEQ ID NO: 3229 - RNA, 20 nt, Homo sapiens
gcuucuccugcucuauucuu

SEQ ID NO: 3230 - RNA, 20 nt, Homo sapiens
cuucuccugcucuauucuug

SEQ ID NO: 3231 - RNA, 20 nt, Homo sapiens
uucuccugcucuauucuugg

SEQ ID NO: 3232 - RNA, 20 nt, Homo sapiens
ucuccugcucuauucuuggc

SEQ ID NO: 3233 - RNA, 20 nt, Homo sapiens
cuccugcucuauucuuggca

SEQ ID NO: 3234 - RNA, 20 nt, Homo sapiens
uccugcucuauucuuggcaa

SEQ ID NO: 3235 - RNA, 20 nt, Homo sapiens
ccugcucuauucuuggcaac

SEQ ID NO: 3236 - RNA, 20 nt, Homo sapiens
cugcucuauucuuggcaaca

SEQ ID NO: 3237 - RNA, 20 nt, Homo sapiens
ugcucuauucuuggcaacac

SEQ ID NO: 3238 - RNA, 20 nt, Homo sapiens
gcucuauucuuggcaacaca

SEQ ID NO: 3239 - RNA, 20 nt, Homo sapiens
cucuauucuuggcaacacau

SEQ ID NO: 3240 - RNA, 20 nt, Homo sapiens
ucuauucuuggcaacacaug

SEQ ID NO: 3241 - RNA, 20 nt, Homo sapiens
cuauucuuggcaacacaugc

SEQ ID NO: 3242 - RNA, 20 nt, Homo sapiens
uauucuuggcaacacaugca

SEQ ID NO: 3243 - RNA, 20 nt, Homo sapiens
auucuuggcaacacaugcau

SEQ ID NO: 3244 - RNA, 20 nt, Homo sapiens
uucuuggcaacacaugcaua

SEQ ID NO: 3245 - RNA, 20 nt, Homo sapiens
ucuuggcaacacaugcauaa

SEQ ID NO: 3246 - RNA, 20 nt, Homo sapiens
cuuggcaacacaugcauaag

SEQ ID NO: 3247 - RNA, 20 nt, Homo sapiens
uuggcaacacaugcauaagc

SEQ ID NO: 3248 - RNA, 20 nt, Homo sapiens
uggcaacacaugcauaagcc

SEQ ID NO: 3249 - RNA, 20 nt, Homo sapiens
ggcaacacaugcauaagccc

SEQ ID NO: 3250 - RNA, 20 nt, Homo sapiens
gcaacacaugcauaagcccc

SEQ ID NO: 3251 - RNA, 20 nt, Homo sapiens
caacacaugcauaagccccu

SEQ ID NO: 3252 - RNA, 20 nt, Homo sapiens
aacacaugcauaagccccug

SEQ ID NO: 3253 - RNA, 20 nt, Homo sapiens
acacaugcauaagccccugc

SEQ ID NO: 3254 - RNA, 20 nt, Homo sapiens
cacaugcauaagccccugca

SEQ ID NO: 3255 - RNA, 20 nt, Homo sapiens
acaugcauaagccccugcau

SEQ ID NO: 3256 - RNA, 20 nt, Homo sapiens
caugcauaagccccugcauc

SEQ ID NO: 3257 - RNA, 20 nt, Homo sapiens
augcauaagccccugcaucu

SEQ ID NO: 3258 - RNA, 20 nt, Homo sapiens
ugcauaagccccugcaucug

SEQ ID NO: 3259 - RNA, 20 nt, Homo sapiens
gcauaagccccugcaucuga

SEQ ID NO: 3260 - RNA, 20 nt, Homo sapiens
cauaagccccugcaucugaa

SEQ ID NO: 3261 - RNA, 20 nt, Homo sapiens
auaagccccugcaucugaag

SEQ ID NO: 3262 - RNA, 20 nt, Homo sapiens
uaagccccugcaucugaagc

SEQ ID NO: 3263 - RNA, 20 nt, Homo sapiens
aagccccugcaucugaagcu

SEQ ID NO: 3264 - RNA, 20 nt, Homo sapiens
agccccugcaucugaagcuc

SEQ ID NO: 3265 - RNA, 20 nt, Homo sapiens
gccccugcaucugaagcucu

SEQ ID NO: 3266 - RNA, 20 nt, Homo sapiens
ccccugcaucugaagcucug

SEQ ID NO: 3267 - RNA, 20 nt, Homo sapiens
cccugcaucugaagcucuga

SEQ ID NO: 3268 - RNA, 20 nt, Homo sapiens
ccugcaucugaagcucugac

SEQ ID NO: 3269 - RNA, 20 nt, Homo sapiens
cugcaucugaagcucugacu

SEQ ID NO: 3270 - RNA, 20 nt, Homo sapiens
ugcaucugaagcucugacua

SEQ ID NO: 3271 - RNA, 20 nt, Homo sapiens
gcaucugaagcucugacuac

SEQ ID NO: 3272 - RNA, 20 nt, Homo sapiens
caucugaagcucugacuacu

SEQ ID NO: 3273 - RNA, 20 nt, Homo sapiens
aucugaagcucugacuacuu

SEQ ID NO: 3274 - RNA, 20 nt, Homo sapiens
ucugaagcucugacuacuuc

SEQ ID NO: 3275 - RNA, 20 nt, Homo sapiens
cugaagcucugacuacuuca

SEQ ID NO: 3276 - RNA, 20 nt, Homo sapiens
ugaagcucugacuacuucaa

SEQ ID NO: 3277 - RNA, 20 nt, Homo sapiens
gaagcucugacuacuucaaa

SEQ ID NO: 3278 - RNA, 20 nt, Homo sapiens
aagcucugacuacuucaaag

SEQ ID NO: 3279 - RNA, 20 nt, Homo sapiens
agcucugacuacuucaaaga

SEQ ID NO: 3280 - RNA, 20 nt, Homo sapiens
gcucugacuacuucaaagau

SEQ ID NO: 3281 - RNA, 20 nt, Homo sapiens
cucugacuacuucaaagaug

SEQ ID NO: 3282 - RNA, 20 nt, Homo sapiens
ucugacuacuucaaagauga

SEQ ID NO: 3283 - RNA, 20 nt, Homo sapiens
cugacuacuucaaagaugag

SEQ ID NO: 3284 - RNA, 20 nt, Homo sapiens
ugacuacuucaaagaugagu

SEQ ID NO: 3285 - RNA, 20 nt, Homo sapiens
gacuacuucaaagaugagug

SEQ ID NO: 3286 - RNA, 20 nt, Homo sapiens
acuacuucaaagaugaguga

SEQ ID NO: 3287 - RNA, 20 nt, Homo sapiens
cuacuucaaagaugagugaa

SEQ ID NO: 3288 - RNA, 20 nt, Homo sapiens
uacuucaaagaugagugaau

SEQ ID NO: 3289 - RNA, 20 nt, Homo sapiens
acuucaaagaugagugaaug

SEQ ID NO: 3290 - RNA, 20 nt, Homo sapiens
cuucaaagaugagugaauga

SEQ ID NO: 3291 - RNA, 20 nt, Homo sapiens
uucaaagaugagugaaugaa

SEQ ID NO: 3292 - RNA, 20 nt, Homo sapiens
ucaaagaugagugaaugaag

SEQ ID NO: 3293 - RNA, 20 nt, Homo sapiens
caaagaugagugaaugaaga

SEQ ID NO: 3294 - RNA, 20 nt, Homo sapiens
aaagaugagugaaugaagac

SEQ ID NO: 3295 - RNA, 20 nt, Homo sapiens
aagaugagugaaugaagacc

SEQ ID NO: 3296 - RNA, 20 nt, Homo sapiens
agaugagugaaugaagaccc

SEQ ID NO: 3297 - RNA, 20 nt, Homo sapiens
gaugagugaaugaagacccu

SEQ ID NO: 3298 - RNA, 20 nt, Homo sapiens
augagugaaugaagacccuu

SEQ ID NO: 3299 - RNA, 20 nt, Homo sapiens
ugagugaaugaagacccuuc

SEQ ID NO: 3300 - RNA, 20 nt, Homo sapiens
gagugaaugaagacccuucu

SEQ ID NO: 3301 - RNA, 20 nt, Homo sapiens
agugaaugaagacccuucuc

SEQ ID NO: 3302 - RNA, 20 nt, Homo sapiens
gugaaugaagacccuucuca

SEQ ID NO: 3303 - RNA, 20 nt, Homo sapiens
ugaaugaagacccuucucag

SEQ ID NO: 3304 - RNA, 20 nt, Homo sapiens
gaaugaagacccuucucaga

SEQ ID NO: 3305 - RNA, 20 nt, Homo sapiens
aaugaagacccuucucagac

SEQ ID NO: 3306 - RNA, 20 nt, Homo sapiens
augaagacccuucucagaca

SEQ ID NO: 3307 - RNA, 20 nt, Homo sapiens
ugaagacccuucucagacac

SEQ ID NO: 3308 - RNA, 20 nt, Homo sapiens
gaagacccuucucagacacu

SEQ ID NO: 3309 - RNA, 20 nt, Homo sapiens
aagacccuucucagacacua

SEQ ID NO: 3310 - RNA, 20 nt, Homo sapiens
agacccuucucagacacuau

SEQ ID NO: 3311 - RNA, 20 nt, Homo sapiens
gacccuucucagacacuauc

SEQ ID NO: 3312 - RNA, 20 nt, Homo sapiens
acccuucucagacacuauca

SEQ ID NO: 3313 - RNA, 20 nt, Homo sapiens
cccuucucagacacuaucau

SEQ ID NO: 3314 - RNA, 20 nt, Homo sapiens
ccuucucagacacuaucauu

SEQ ID NO: 3315 - RNA, 20 nt, Homo sapiens
cuucucagacacuaucauuu

SEQ ID NO: 3316 - RNA, 20 nt, Homo sapiens
uucucagacacuaucauuuu

SEQ ID NO: 3317 - RNA, 20 nt, Homo sapiens
ucucagacacuaucauuuug

SEQ ID NO: 3318 - RNA, 20 nt, Homo sapiens
cucagacacuaucauuuugu

SEQ ID NO: 3319 - RNA, 20 nt, Homo sapiens
ucagacacuaucauuuugug

SEQ ID NO: 3320 - RNA, 20 nt, Homo sapiens
cagacacuaucauuuugugc

SEQ ID NO: 3321 - RNA, 20 nt, Homo sapiens
agacacuaucauuuugugca

SEQ ID NO: 3322 - RNA, 20 nt, Homo sapiens
gacacuaucauuuugugcaa

SEQ ID NO: 3323 - RNA, 20 nt, Homo sapiens
acacuaucauuuugugcaaa

SEQ ID NO: 3324 - RNA, 20 nt, Homo sapiens
cacuaucauuuugugcaaau

SEQ ID NO: 3325 - RNA, 20 nt, Homo sapiens
acuaucauuuugugcaaauc

SEQ ID NO: 3326 - RNA, 20 nt, Homo sapiens
cuaucauuuugugcaaauca

SEQ ID NO: 3327 - RNA, 20 nt, Homo sapiens
uaucauuuugugcaaaucau

SEQ ID NO: 3328 - RNA, 20 nt, Homo sapiens
aucauuuugugcaaaucauc

SEQ ID NO: 3329 - RNA, 20 nt, Homo sapiens
ucauuuugugcaaaucaucu

SEQ ID NO: 3330 - RNA, 20 nt, Homo sapiens
cauuuugugcaaaucaucug

SEQ ID NO: 3331 - RNA, 20 nt, Homo sapiens
auuuugugcaaaucaucuga

SEQ ID NO: 3332 - RNA, 20 nt, Homo sapiens
uuuugugcaaaucaucugau

SEQ ID NO: 3333 - RNA, 20 nt, Homo sapiens
uuugugcaaaucaucugauu

SEQ ID NO: 3334 - RNA, 20 nt, Homo sapiens
uugugcaaaucaucugauug

SEQ ID NO: 3335 - RNA, 20 nt, Homo sapiens
ugugcaaaucaucugauuga

SEQ ID NO: 3336 - RNA, 20 nt, Homo sapiens
gugcaaaucaucugauugaa

SEQ ID NO: 3337 - RNA, 20 nt, Homo sapiens
ugcaaaucaucugauugaac

SEQ ID NO: 3338 - RNA, 20 nt, Homo sapiens
gcaaaucaucugauugaacu

SEQ ID NO: 3339 - RNA, 20 nt, Homo sapiens
caaaucaucugauugaacug

SEQ ID NO: 3340 - RNA, 20 nt, Homo sapiens
aaaucaucugauugaacugu

SEQ ID NO: 3341 - RNA, 20 nt, Homo sapiens
aaucaucugauugaacuguu

SEQ ID NO: 3342 - RNA, 20 nt, Homo sapiens
aucaucugauugaacuguuc

SEQ ID NO: 3343 - RNA, 20 nt, Homo sapiens
ucaucugauugaacuguucu

SEQ ID NO: 3344 - RNA, 20 nt, Homo sapiens
caucugauugaacuguucuu

SEQ ID NO: 3345 - RNA, 20 nt, Homo sapiens
aucugauugaacuguucuuc

SEQ ID NO: 3346 - RNA, 20 nt, Homo sapiens
ucugauugaacuguucuucc

SEQ ID NO: 3347 - RNA, 20 nt, Homo sapiens
cugauugaacuguucuucca

SEQ ID NO: 3348 - RNA, 20 nt, Homo sapiens
ugauugaacuguucuuccau

SEQ ID NO: 3349 - RNA, 20 nt, Homo sapiens
gauugaacuguucuuccauu

SEQ ID NO: 3350 - RNA, 20 nt, Homo sapiens
auugaacuguucuuccauuu

SEQ ID NO: 3351 - RNA, 20 nt, Homo sapiens
uugaacuguucuuccauuua

SEQ ID NO: 3352 - RNA, 20 nt, Homo sapiens
ugaacuguucuuccauuuag

SEQ ID NO: 3353 - RNA, 20 nt, Homo sapiens
gaacuguucuuccauuuaga

SEQ ID NO: 3354 - RNA, 20 nt, Homo sapiens
aacuguucuuccauuuagau

SEQ ID NO: 3355 - RNA, 20 nt, Homo sapiens
acuguucuuccauuuagaua

SEQ ID NO: 3356 - RNA, 20 nt, Homo sapiens
cuguucuuccauuuagauac

SEQ ID NO: 3357 - RNA, 20 nt, Homo sapiens
uguucuuccauuuagauacc

SEQ ID NO: 3358 - RNA, 20 nt, Homo sapiens
guucuuccauuuagauacca

SEQ ID NO: 3359 - RNA, 20 nt, Homo sapiens
uucuuccauuuagauaccau

SEQ ID NO: 3360 - RNA, 20 nt, Homo sapiens
ucuuccauuuagauaccaug

SEQ ID NO: 3361 - RNA, 20 nt, Homo sapiens
cuuccauuuagauaccauga

SEQ ID NO: 3362 - RNA, 20 nt, Homo sapiens
uuccauuuagauaccaugac

SEQ ID NO: 3363 - RNA, 20 nt, Homo sapiens
uccauuuagauaccaugaca

SEQ ID NO: 3364 - RNA, 20 nt, Homo sapiens
ccauuuagauaccaugacac

SEQ ID NO: 3365 - RNA, 20 nt, Homo sapiens
cauuuagauaccaugacaca

SEQ ID NO: 3366 - RNA, 20 nt, Homo sapiens
auuuagauaccaugacacau

SEQ ID NO: 3367 - RNA, 20 nt, Homo sapiens
uuuagauaccaugacacauc

SEQ ID NO: 3368 - RNA, 20 nt, Homo sapiens
uuagauaccaugacacauca

SEQ ID NO: 3369 - RNA, 20 nt, Homo sapiens
uagauaccaugacacaucag

SEQ ID NO: 3370 - RNA, 20 nt, Homo sapiens
agauaccaugacacaucagg

SEQ ID NO: 3371 - RNA, 20 nt, Homo sapiens
gauaccaugacacaucagga

SEQ ID NO: 3372 - RNA, 20 nt, Homo sapiens
auaccaugacacaucaggag

SEQ ID NO: 3373 - RNA, 20 nt, Homo sapiens
uaccaugacacaucaggagc

SEQ ID NO: 3374 - RNA, 20 nt, Homo sapiens
accaugacacaucaggagcu

SEQ ID NO: 3375 - RNA, 20 nt, Homo sapiens
ccaugacacaucaggagcug

SEQ ID NO: 3376 - RNA, 20 nt, Homo sapiens
caugacacaucaggagcugg

SEQ ID NO: 3377 - RNA, 20 nt, Homo sapiens
augacacaucaggagcuggc

SEQ ID NO: 3378 - RNA, 20 nt, Homo sapiens
ugacacaucaggagcuggca

SEQ ID NO: 3379 - RNA, 20 nt, Homo sapiens
gacacaucaggagcuggcag

SEQ ID NO: 3380 - RNA, 20 nt, Homo sapiens
acacaucaggagcuggcagu

SEQ ID NO: 3381 - RNA, 20 nt, Homo sapiens
cacaucaggagcuggcaguc

SEQ ID NO: 3382 - RNA, 20 nt, Homo sapiens
acaucaggagcuggcagucc

SEQ ID NO: 3383 - RNA, 20 nt, Homo sapiens
caucaggagcuggcagucca

SEQ ID NO: 3384 - RNA, 20 nt, Homo sapiens
aucaggagcuggcaguccac

SEQ ID NO: 3385 - RNA, 20 nt, Homo sapiens
ucaggagcuggcaguccacu

SEQ ID NO: 3386 - RNA, 20 nt, Homo sapiens
caggagcuggcaguccacuc

SEQ ID NO: 3387 - RNA, 20 nt, Homo sapiens
aggagcuggcaguccacuca

SEQ ID NO: 3388 - RNA, 20 nt, Homo sapiens
ggagcuggcaguccacucac

SEQ ID NO: 3389 - RNA, 20 nt, Homo sapiens
gagcuggcaguccacucacu

SEQ ID NO: 3390 - RNA, 20 nt, Homo sapiens
agcuggcaguccacucacuu

SEQ ID NO: 3391 - RNA, 20 nt, Homo sapiens
gcuggcaguccacucacuuu

SEQ ID NO: 3392 - RNA, 20 nt, Homo sapiens
cuggcaguccacucacuuug

SEQ ID NO: 3393 - RNA, 20 nt, Homo sapiens
uggcaguccacucacuuuga

SEQ ID NO: 3394 - RNA, 20 nt, Homo sapiens
ggcaguccacucacuuugaa

SEQ ID NO: 3395 - RNA, 20 nt, Homo sapiens
gcaguccacucacuuugaag

SEQ ID NO: 3396 - RNA, 20 nt, Homo sapiens
caguccacucacuuugaagu

SEQ ID NO: 3397 - RNA, 20 nt, Homo sapiens
aguccacucacuuugaaguc

SEQ ID NO: 3398 - RNA, 20 nt, Homo sapiens
guccacucacuuugaagucc

SEQ ID NO: 3399 - RNA, 20 nt, Homo sapiens
uccacucacuuugaagucca

SEQ ID NO: 3400 - RNA, 20 nt, Homo sapiens
ccacucacuuugaaguccau

SEQ ID NO: 3401 - RNA, 20 nt, Homo sapiens
cacucacuuugaaguccauu

SEQ ID NO: 3402 - RNA, 20 nt, Homo sapiens
acucacuuugaaguccauuc

SEQ ID NO: 3403 - RNA, 20 nt, Homo sapiens
cucacuuugaaguccauucu

SEQ ID NO: 3404 - RNA, 20 nt, Homo sapiens
ucacuuugaaguccauucug

SEQ ID NO: 3405 - RNA, 20 nt, Homo sapiens
cacuuugaaguccauucugc

SEQ ID NO: 3406 - RNA, 20 nt, Homo sapiens
acuuugaaguccauucugca

SEQ ID NO: 3407 - RNA, 20 nt, Homo sapiens
cuuugaaguccauucugcag

SEQ ID NO: 3408 - RNA, 20 nt, Homo sapiens
uuugaaguccauucugcaga

SEQ ID NO: 3409 - RNA, 20 nt, Homo sapiens
uugaaguccauucugcagaa

SEQ ID NO: 3410 - RNA, 20 nt, Homo sapiens
ugaaguccauucugcagaau

SEQ ID NO: 3411 - RNA, 20 nt, Homo sapiens
gaaguccauucugcagaauc

SEQ ID NO: 3412 - RNA, 20 nt, Homo sapiens
aaguccauucugcagaaucu

SEQ ID NO: 3413 - RNA, 20 nt, Homo sapiens
aguccauucugcagaaucuu

SEQ ID NO: 3414 - RNA, 20 nt, Homo sapiens
guccauucugcagaaucuuc

SEQ ID NO: 3415 - RNA, 20 nt, Homo sapiens
uccauucugcagaaucuucc

SEQ ID NO: 3416 - RNA, 20 nt, Homo sapiens
ccauucugcagaaucuuccu

SEQ ID NO: 3417 - RNA, 20 nt, Homo sapiens
cauucugcagaaucuuccuu

SEQ ID NO: 3418 - RNA, 20 nt, Homo sapiens
auucugcagaaucuuccuuc

SEQ ID NO: 3419 - RNA, 20 nt, Homo sapiens
uucugcagaaucuuccuuca

SEQ ID NO: 3420 - RNA, 20 nt, Homo sapiens
ucugcagaaucuuccuucau

SEQ ID NO: 3421 - RNA, 20 nt, Homo sapiens
cugcagaaucuuccuucauc

SEQ ID NO: 3422 - RNA, 20 nt, Homo sapiens
ugcagaaucuuccuucauca

SEQ ID NO: 3423 - RNA, 20 nt, Homo sapiens
gcagaaucuuccuucaucaa

SEQ ID NO: 3424 - RNA, 20 nt, Homo sapiens
cagaaucuuccuucaucaau

SEQ ID NO: 3425 - RNA, 20 nt, Homo sapiens
agaaucuuccuucaucaauc

SEQ ID NO: 3426 - RNA, 20 nt, Homo sapiens
gaaucuuccuucaucaaucg

SEQ ID NO: 3427 - RNA, 20 nt, Homo sapiens
aaucuuccuucaucaaucga

SEQ ID NO: 3428 - RNA, 20 nt, Homo sapiens
aucuuccuucaucaaucgac

SEQ ID NO: 3429 - RNA, 20 nt, Homo sapiens
ucuuccuucaucaaucgaca

SEQ ID NO: 3430 - RNA, 20 nt, Homo sapiens
cuuccuucaucaaucgacau

SEQ ID NO: 3431 - RNA, 20 nt, Homo sapiens
uuccuucaucaaucgacaug

SEQ ID NO: 3432 - RNA, 20 nt, Homo sapiens
uccuucaucaaucgacaugu

SEQ ID NO: 3433 - RNA, 20 nt, Homo sapiens
ccuucaucaaucgacauguu

SEQ ID NO: 3434 - RNA, 20 nt, Homo sapiens
cuucaucaaucgacauguuc

SEQ ID NO: 3435 - RNA, 20 nt, Homo sapiens
uucaucaaucgacauguucu

SEQ ID NO: 3436 - RNA, 20 nt, Homo sapiens
ucaucaaucgacauguucuc

SEQ ID NO: 3437 - RNA, 20 nt, Homo sapiens
caucaaucgacauguucucu

SEQ ID NO: 3438 - RNA, 20 nt, Homo sapiens
aucaaucgacauguucucug

SEQ ID NO: 3439 - RNA, 20 nt, Homo sapiens
ucaaucgacauguucucugg

SEQ ID NO: 3440 - RNA, 20 nt, Homo sapiens
caaucgacauguucucuggc

SEQ ID NO: 3441 - RNA, 20 nt, Homo sapiens
aaucgacauguucucuggca

SEQ ID NO: 3442 - RNA, 20 nt, Homo sapiens
aucgacauguucucuggcac

SEQ ID NO: 3443 - RNA, 20 nt, Homo sapiens
ucgacauguucucuggcacu

SEQ ID NO: 3444 - RNA, 20 nt, Homo sapiens
cgacauguucucuggcacuu

SEQ ID NO: 3445 - RNA, 20 nt, Homo sapiens
gacauguucucuggcacuug

SEQ ID NO: 3446 - RNA, 20 nt, Homo sapiens
acauguucucuggcacuuga

SEQ ID NO: 3447 - RNA, 20 nt, Homo sapiens
cauguucucuggcacuugaa

SEQ ID NO: 3448 - RNA, 20 nt, Homo sapiens
auguucucuggcacuugaau

SEQ ID NO: 3449 - RNA, 20 nt, Homo sapiens
uguucucuggcacuugaaug

SEQ ID NO: 3450 - RNA, 20 nt, Homo sapiens
guucucuggcacuugaauga

SEQ ID NO: 3451 - RNA, 20 nt, Homo sapiens
uucucuggcacuugaaugaa

SEQ ID NO: 3452 - RNA, 20 nt, Homo sapiens
ucucuggcacuugaaugaaa

SEQ ID NO: 3453 - RNA, 20 nt, Homo sapiens
cucuggcacuugaaugaaac

SEQ ID NO: 3454 - RNA, 20 nt, Homo sapiens
ucuggcacuugaaugaaacg

SEQ ID NO: 3455 - RNA, 20 nt, Homo sapiens
cuggcacuugaaugaaacgu

SEQ ID NO: 3456 - RNA, 20 nt, Homo sapiens
uggcacuugaaugaaacgug

SEQ ID NO: 3457 - RNA, 20 nt, Homo sapiens
ggcacuugaaugaaacgugg

SEQ ID NO: 3458 - RNA, 20 nt, Homo sapiens
gcacuugaaugaaacguggu

SEQ ID NO: 3459 - RNA, 20 nt, Homo sapiens
cacuugaaugaaacguggug

SEQ ID NO: 3460 - RNA, 20 nt, Homo sapiens
acuugaaugaaacguggugg

SEQ ID NO: 3461 - RNA, 20 nt, Homo sapiens
cuugaaugaaacgugguggg

SEQ ID NO: 3462 - RNA, 20 nt, Homo sapiens
uugaaugaaacguggugggu

SEQ ID NO: 3463 - RNA, 20 nt, Homo sapiens
ugaaugaaacguggugggua

SEQ ID NO: 3464 - RNA, 20 nt, Homo sapiens
gaaugaaacgugguggguaa

SEQ ID NO: 3465 - RNA, 20 nt, Homo sapiens
aaugaaacgugguggguaaa

SEQ ID NO: 3466 - RNA, 20 nt, Homo sapiens
augaaacgugguggguaaaa

SEQ ID NO: 3467 - RNA, 20 nt, Homo sapiens
ugaaacgugguggguaaaau

SEQ ID NO: 3468 - RNA, 20 nt, Homo sapiens
gaaacgugguggguaaaauu

SEQ ID NO: 3469 - RNA, 20 nt, Homo sapiens
aaacgugguggguaaaauuu

SEQ ID NO: 3470 - RNA, 20 nt, Homo sapiens
aacgugguggguaaaauuuc

SEQ ID NO: 3471 - RNA, 20 nt, Homo sapiens
acgugguggguaaaauuucu

SEQ ID NO: 3472 - RNA, 20 nt, Homo sapiens
cgugguggguaaaauuucuc

SEQ ID NO: 3473 - RNA, 20 nt, Homo sapiens
gugguggguaaaauuucucc

SEQ ID NO: 3474 - RNA, 20 nt, Homo sapiens
ugguggguaaaauuucuccu

SEQ ID NO: 3475 - RNA, 20 nt, Homo sapiens
gguggguaaaauuucuccug

SEQ ID NO: 3476 - RNA, 20 nt, Homo sapiens
guggguaaaauuucuccugg

SEQ ID NO: 3477 - RNA, 20 nt, Homo sapiens
uggguaaaauuucuccugga

SEQ ID NO: 3478 - RNA, 20 nt, Homo sapiens
ggguaaaauuucuccuggau

SEQ ID NO: 3479 - RNA, 20 nt, Homo sapiens
gguaaaauuucuccuggauu

SEQ ID NO: 3480 - RNA, 20 nt, Homo sapiens
guaaaauuucuccuggauug

SEQ ID NO: 3481 - RNA, 20 nt, Homo sapiens
uaaaauuucuccuggauugc

SEQ ID NO: 3482 - RNA, 20 nt, Homo sapiens
aaaauuucuccuggauugca

SEQ ID NO: 3483 - RNA, 20 nt, Homo sapiens
aaauuucuccuggauugcau

SEQ ID NO: 3484 - RNA, 20 nt, Homo sapiens
aauuucuccuggauugcauc

SEQ ID NO: 3485 - RNA, 20 nt, Homo sapiens
auuucuccuggauugcaucc

SEQ ID NO: 3486 - RNA, 20 nt, Homo sapiens
uuucuccuggauugcauccu

SEQ ID NO: 3487 - RNA, 20 nt, Homo sapiens
uucuccuggauugcauccug

SEQ ID NO: 3488 - RNA, 20 nt, Homo sapiens
ucuccuggauugcauccuga

SEQ ID NO: 3489 - RNA, 20 nt, Homo sapiens
cuccuggauugcauccugau

SEQ ID NO: 3490 - RNA, 20 nt, Homo sapiens
uccuggauugcauccugauc

SEQ ID NO: 3491 - RNA, 20 nt, Homo sapiens
ccuggauugcauccugauca

SEQ ID NO: 3492 - RNA, 20 nt, Homo sapiens
cuggauugcauccugaucau

SEQ ID NO: 3493 - RNA, 20 nt, Homo sapiens
uggauugcauccugaucauu

SEQ ID NO: 3494 - RNA, 20 nt, Homo sapiens
ggauugcauccugaucauuc

SEQ ID NO: 3495 - RNA, 20 nt, Homo sapiens
gauugcauccugaucauuca

SEQ ID NO: 3496 - RNA, 20 nt, Homo sapiens
auugcauccugaucauucac

SEQ ID NO: 3497 - RNA, 20 nt, Homo sapiens
uugcauccugaucauucaca

SEQ ID NO: 3498 - RNA, 20 nt, Homo sapiens
ugcauccugaucauucacau

SEQ ID NO: 3499 - RNA, 20 nt, Homo sapiens
gcauccugaucauucacauc

SEQ ID NO: 3500 - RNA, 20 nt, Homo sapiens
cauccugaucauucacaucu

SEQ ID NO: 3501 - RNA, 20 nt, Homo sapiens
auccugaucauucacaucuc

SEQ ID NO: 3502 - RNA, 20 nt, Homo sapiens
uccugaucauucacaucucc

SEQ ID NO: 3503 - RNA, 20 nt, Homo sapiens
ccugaucauucacaucuccc

SEQ ID NO: 3504 - RNA, 20 nt, Homo sapiens
cugaucauucacaucucccc

SEQ ID NO: 3505 - RNA, 20 nt, Homo sapiens
ugaucauucacaucuccccu

SEQ ID NO: 3506 - RNA, 20 nt, Homo sapiens
gaucauucacaucuccccuu

SEQ ID NO: 3507 - RNA, 20 nt, Homo sapiens
aucauucacaucuccccuug

SEQ ID NO: 3508 - RNA, 20 nt, Homo sapiens
ucauucacaucuccccuuga

SEQ ID NO: 3509 - RNA, 20 nt, Homo sapiens
cauucacaucuccccuugag

SEQ ID NO: 3510 - RNA, 20 nt, Homo sapiens
auucacaucuccccuugagg

SEQ ID NO: 3511 - RNA, 20 nt, Homo sapiens
uucacaucuccccuugaggu

SEQ ID NO: 3512 - RNA, 20 nt, Homo sapiens
ucacaucuccccuugagguu

SEQ ID NO: 3513 - RNA, 20 nt, Homo sapiens
cacaucuccccuugagguug

SEQ ID NO: 3514 - RNA, 20 nt, Homo sapiens
acaucuccccuugagguuga

SEQ ID NO: 3515 - RNA, 20 nt, Homo sapiens
caucuccccuugagguugau

SEQ ID NO: 3516 - RNA, 20 nt, Homo sapiens
aucuccccuugagguugauc

SEQ ID NO: 3517 - RNA, 20 nt, Homo sapiens
ucuccccuugagguugaucu

SEQ ID NO: 3518 - RNA, 20 nt, Homo sapiens
cuccccuugagguugaucua

SEQ ID NO: 3519 - RNA, 20 nt, Homo sapiens
uccccuugagguugaucuac

SEQ ID NO: 3520 - RNA, 20 nt, Homo sapiens
ccccuugagguugaucuacu

SEQ ID NO: 3521 - RNA, 20 nt, Homo sapiens
cccuugagguugaucuacuu

SEQ ID NO: 3522 - RNA, 20 nt, Homo sapiens
ccuugagguugaucuacuuc

SEQ ID NO: 3523 - RNA, 20 nt, Homo sapiens
cuugagguugaucuacuucu

SEQ ID NO: 3524 - RNA, 20 nt, Homo sapiens
uugagguugaucuacuucuu

SEQ ID NO: 3525 - RNA, 20 nt, Homo sapiens
ugagguugaucuacuucuua

SEQ ID NO: 3526 - RNA, 20 nt, Homo sapiens
gagguugaucuacuucuuac

SEQ ID NO: 3527 - RNA, 20 nt, Homo sapiens
agguugaucuacuucuuacu

SEQ ID NO: 3528 - RNA, 20 nt, Homo sapiens
gguugaucuacuucuuacuu

SEQ ID NO: 3529 - RNA, 20 nt, Homo sapiens
guugaucuacuucuuacuug

SEQ ID NO: 3530 - RNA, 20 nt, Homo sapiens
uugaucuacuucuuacuugu

SEQ ID NO: 3531 - RNA, 20 nt, Homo sapiens
ugaucuacuucuuacuugug

SEQ ID NO: 3532 - RNA, 20 nt, Homo sapiens
gaucuacuucuuacuuguga

SEQ ID NO: 3533 - RNA, 20 nt, Homo sapiens
aucuacuucuuacuugugau

SEQ ID NO: 3534 - RNA, 20 nt, Homo sapiens
ucuacuucuuacuugugaug

SEQ ID NO: 3535 - RNA, 20 nt, Homo sapiens
cuacuucuuacuugugaugu

SEQ ID NO: 3536 - RNA, 20 nt, Homo sapiens
uacuucuuacuugugaugua

SEQ ID NO: 3537 - RNA, 20 nt, Homo sapiens
acuucuuacuugugauguag

SEQ ID NO: 3538 - RNA, 20 nt, Homo sapiens
cuucuuacuugugauguagg

SEQ ID NO: 3539 - RNA, 20 nt, Homo sapiens
uucuuacuugugauguagga

SEQ ID NO: 3540 - RNA, 20 nt, Homo sapiens
ucuuacuugugauguaggaa

SEQ ID NO: 3541 - RNA, 20 nt, Homo sapiens
cuuacuugugauguaggaac

SEQ ID NO: 3542 - RNA, 20 nt, Homo sapiens
uuacuugugauguaggaacu

SEQ ID NO: 3543 - RNA, 20 nt, Homo sapiens
uacuugugauguaggaacuu

SEQ ID NO: 3544 - RNA, 20 nt, Homo sapiens
acuugugauguaggaacuug

SEQ ID NO: 3545 - RNA, 20 nt, Homo sapiens
cuugugauguaggaacuugc

SEQ ID NO: 3546 - RNA, 20 nt, Homo sapiens
uugugauguaggaacuugca

SEQ ID NO: 3547 - RNA, 20 nt, Homo sapiens
ugugauguaggaacuugcag

SEQ ID NO: 3548 - RNA, 20 nt, Homo sapiens
gugauguaggaacuugcagu

SEQ ID NO: 3549 - RNA, 20 nt, Homo sapiens
ugauguaggaacuugcaguc

SEQ ID NO: 3550 - RNA, 20 nt, Homo sapiens
gauguaggaacuugcagucg

SEQ ID NO: 3551 - RNA, 20 nt, Homo sapiens
auguaggaacuugcagucgc

SEQ ID NO: 3552 - RNA, 20 nt, Homo sapiens
uguaggaacuugcagucgcg

SEQ ID NO: 3553 - RNA, 20 nt, Homo sapiens
guaggaacuugcagucgcgc

SEQ ID NO: 3554 - RNA, 20 nt, Homo sapiens
uaggaacuugcagucgcgca

SEQ ID NO: 3555 - RNA, 20 nt, Homo sapiens
aggaacuugcagucgcgcau

SEQ ID NO: 3556 - RNA, 20 nt, Homo sapiens
ggaacuugcagucgcgcaug

SEQ ID NO: 3557 - RNA, 20 nt, Homo sapiens
gaacuugcagucgcgcaugu

SEQ ID NO: 3558 - RNA, 20 nt, Homo sapiens
aacuugcagucgcgcauguu

SEQ ID NO: 3559 - RNA, 20 nt, Homo sapiens
acuugcagucgcgcauguuc

SEQ ID NO: 3560 - RNA, 20 nt, Homo sapiens
cuugcagucgcgcauguucu

SEQ ID NO: 3561 - RNA, 20 nt, Homo sapiens
uugcagucgcgcauguucug

SEQ ID NO: 3562 - RNA, 20 nt, Homo sapiens
ugcagucgcgcauguucuga

SEQ ID NO: 3563 - RNA, 20 nt, Homo sapiens
gcagucgcgcauguucugag

SEQ ID NO: 3564 - RNA, 20 nt, Homo sapiens
cagucgcgcauguucugagu

SEQ ID NO: 3565 - RNA, 20 nt, Homo sapiens
agucgcgcauguucugaguu

SEQ ID NO: 3566 - RNA, 20 nt, Homo sapiens
gucgcgcauguucugaguug

SEQ ID NO: 3567 - RNA, 20 nt, Homo sapiens
ucgcgcauguucugaguugu

SEQ ID NO: 3568 - RNA, 20 nt, Homo sapiens
cgcgcauguucugaguugug

SEQ ID NO: 3569 - RNA, 20 nt, Homo sapiens
gcgcauguucugaguugugu

SEQ ID NO: 3570 - RNA, 20 nt, Homo sapiens
cgcauguucugaguuguguu

SEQ ID NO: 3571 - RNA, 20 nt, Homo sapiens
gcauguucugaguuguguug

SEQ ID NO: 3572 - RNA, 20 nt, Homo sapiens
cauguucugaguuguguugc

SEQ ID NO: 3573 - RNA, 20 nt, Homo sapiens
auguucugaguuguguugcu

SEQ ID NO: 3574 - RNA, 20 nt, Homo sapiens
uguucugaguuguguugcug

SEQ ID NO: 3575 - RNA, 20 nt, Homo sapiens
guucugaguuguguugcugc

SEQ ID NO: 3576 - RNA, 20 nt, Homo sapiens
uucugaguuguguugcugcg

SEQ ID NO: 3577 - RNA, 20 nt, Homo sapiens
ucugaguuguguugcugcga

SEQ ID NO: 3578 - RNA, 20 nt, Homo sapiens
cugaguuguguugcugcgag

SEQ ID NO: 3579 - RNA, 20 nt, Homo sapiens
ugaguuguguugcugcgagu

SEQ ID NO: 3580 - RNA, 20 nt, Homo sapiens
gaguuguguugcugcgaguc

SEQ ID NO: 3581 - RNA, 20 nt, Homo sapiens
aguuguguugcugcgagucu

SEQ ID NO: 3582 - RNA, 20 nt, Homo sapiens
guuguguugcugcgagucuu

SEQ ID NO: 3583 - RNA, 20 nt, Homo sapiens
uuguguugcugcgagucuug

SEQ ID NO: 3584 - RNA, 20 nt, Homo sapiens
uguguugcugcgagucuugu

SEQ ID NO: 3585 - RNA, 20 nt, Homo sapiens
guguugcugcgagucuugug

SEQ ID NO: 3586 - RNA, 20 nt, Homo sapiens
uguugcugcgagucuugugc

SEQ ID NO: 3587 - RNA, 20 nt, Homo sapiens
guugcugcgagucuugugca

SEQ ID NO: 3588 - RNA, 20 nt, Homo sapiens
uugcugcgagucuugugcac

SEQ ID NO: 3589 - RNA, 20 nt, Homo sapiens
ugcugcgagucuugugcacc

SEQ ID NO: 3590 - RNA, 20 nt, Homo sapiens
gcugcgagucuugugcacca

SEQ ID NO: 3591 - RNA, 20 nt, Homo sapiens
cugcgagucuugugcaccac

SEQ ID NO: 3592 - RNA, 20 nt, Homo sapiens
ugcgagucuugugcaccacu

SEQ ID NO: 3593 - RNA, 20 nt, Homo sapiens
gcgagucuugugcaccacug

SEQ ID NO: 3594 - RNA, 20 nt, Homo sapiens
cgagucuugugcaccacugu

SEQ ID NO: 3595 - RNA, 20 nt, Homo sapiens
gagucuugugcaccacuguc

SEQ ID NO: 3596 - RNA, 20 nt, Homo sapiens
agucuugugcaccacuguca

SEQ ID NO: 3597 - RNA, 20 nt, Homo sapiens
gucuugugcaccacugucau

SEQ ID NO: 3598 - RNA, 20 nt, Homo sapiens
ucuugugcaccacugucauc

SEQ ID NO: 3599 - RNA, 20 nt, Homo sapiens
cuugugcaccacugucaucc

SEQ ID NO: 3600 - RNA, 20 nt, Homo sapiens
uugugcaccacugucauccu

SEQ ID NO: 3601 - RNA, 20 nt, Homo sapiens
ugugcaccacugucauccug

SEQ ID NO: 3602 - RNA, 20 nt, Homo sapiens
gugcaccacugucauccuga

SEQ ID NO: 3603 - RNA, 20 nt, Homo sapiens
ugcaccacugucauccugag

SEQ ID NO: 3604 - RNA, 20 nt, Homo sapiens
gcaccacugucauccugagc

SEQ ID NO: 3605 - RNA, 20 nt, Homo sapiens
caccacugucauccugagcu

SEQ ID NO: 3606 - RNA, 20 nt, Homo sapiens
accacugucauccugagcuu

SEQ ID NO: 3607 - RNA, 20 nt, Homo sapiens
ccacugucauccugagcuug

SEQ ID NO: 3608 - RNA, 20 nt, Homo sapiens
cacugucauccugagcuuga

SEQ ID NO: 3609 - RNA, 20 nt, Homo sapiens
acugucauccugagcuugaa

SEQ ID NO: 3610 - RNA, 20 nt, Homo sapiens
cugucauccugagcuugaaa

SEQ ID NO: 3611 - RNA, 20 nt, Homo sapiens
ugucauccugagcuugaaac

SEQ ID NO: 3612 - RNA, 20 nt, Homo sapiens
gucauccugagcuugaaaca

SEQ ID NO: 3613 - RNA, 20 nt, Homo sapiens
ucauccugagcuugaaacac

SEQ ID NO: 3614 - RNA, 20 nt, Homo sapiens
cauccugagcuugaaacaca

SEQ ID NO: 3615 - RNA, 20 nt, Homo sapiens
auccugagcuugaaacacag

SEQ ID NO: 3616 - RNA, 20 nt, Homo sapiens
uccugagcuugaaacacagc

SEQ ID NO: 3617 - RNA, 20 nt, Homo sapiens
ccugagcuugaaacacagca

SEQ ID NO: 3618 - RNA, 20 nt, Homo sapiens
cugagcuugaaacacagcag

SEQ ID NO: 3619 - RNA, 20 nt, Homo sapiens
ugagcuugaaacacagcagc

SEQ ID NO: 3620 - RNA, 20 nt, Homo sapiens
gagcuugaaacacagcagcu

SEQ ID NO: 3621 - RNA, 20 nt, Homo sapiens
agcuugaaacacagcagcug

SEQ ID NO: 3622 - RNA, 20 nt, Homo sapiens
gcuugaaacacagcagcugc

SEQ ID NO: 3623 - RNA, 20 nt, Homo sapiens
cuugaaacacagcagcugca

SEQ ID NO: 3624 - RNA, 20 nt, Homo sapiens
uugaaacacagcagcugcau

SEQ ID NO: 3625 - RNA, 20 nt, Homo sapiens
ugaaacacagcagcugcauu

SEQ ID NO: 3626 - RNA, 20 nt, Homo sapiens
gaaacacagcagcugcauuc

SEQ ID NO: 3627 - RNA, 20 nt, Homo sapiens
aaacacagcagcugcauucu

SEQ ID NO: 3628 - RNA, 20 nt, Homo sapiens
aacacagcagcugcauucug

SEQ ID NO: 3629 - RNA, 20 nt, Homo sapiens
acacagcagcugcauucugu

SEQ ID NO: 3630 - RNA, 20 nt, Homo sapiens
cacagcagcugcauucugug

SEQ ID NO: 3631 - RNA, 20 nt, Homo sapiens
acagcagcugcauucugugg

SEQ ID NO: 3632 - RNA, 20 nt, Homo sapiens
cagcagcugcauucuguggu

SEQ ID NO: 3633 - RNA, 20 nt, Homo sapiens
agcagcugcauucugugguc

SEQ ID NO: 3634 - RNA, 20 nt, Homo sapiens
gcagcugcauucuguggucc

SEQ ID NO: 3635 - RNA, 20 nt, Homo sapiens
cagcugcauucugugguccu

SEQ ID NO: 3636 - RNA, 20 nt, Homo sapiens
agcugcauucugugguccua

SEQ ID NO: 3637 - RNA, 20 nt, Homo sapiens
gcugcauucugugguccuag

SEQ ID NO: 3638 - RNA, 20 nt, Homo sapiens
cugcauucugugguccuagc

SEQ ID NO: 3639 - RNA, 20 nt, Homo sapiens
ugcauucugugguccuagca

SEQ ID NO: 3640 - RNA, 20 nt, Homo sapiens
gcauucugugguccuagcaa

SEQ ID NO: 3641 - RNA, 20 nt, Homo sapiens
cauucugugguccuagcaau

SEQ ID NO: 3642 - RNA, 20 nt, Homo sapiens
auucugugguccuagcaauc

SEQ ID NO: 3643 - RNA, 20 nt, Homo sapiens
uucugugguccuagcaaucu

SEQ ID NO: 3644 - RNA, 20 nt, Homo sapiens
ucugugguccuagcaaucug

SEQ ID NO: 3645 - RNA, 20 nt, Homo sapiens
cugugguccuagcaaucugc

SEQ ID NO: 3646 - RNA, 20 nt, Homo sapiens
ugugguccuagcaaucugcg

SEQ ID NO: 3647 - RNA, 20 nt, Homo sapiens
gugguccuagcaaucugcga

SEQ ID NO: 3648 - RNA, 20 nt, Homo sapiens
ugguccuagcaaucugcgag

SEQ ID NO: 3649 - RNA, 20 nt, Homo sapiens
gguccuagcaaucugcgagc

SEQ ID NO: 3650 - RNA, 20 nt, Homo sapiens
guccuagcaaucugcgagcc

SEQ ID NO: 3651 - RNA, 20 nt, Homo sapiens
uccuagcaaucugcgagcca

SEQ ID NO: 3652 - RNA, 20 nt, Homo sapiens
ccuagcaaucugcgagccau

SEQ ID NO: 3653 - RNA, 20 nt, Homo sapiens
cuagcaaucugcgagccauc

SEQ ID NO: 3654 - RNA, 20 nt, Homo sapiens
uagcaaucugcgagccaucu

SEQ ID NO: 3655 - RNA, 20 nt, Homo sapiens
agcaaucugcgagccaucuu

SEQ ID NO: 3656 - RNA, 20 nt, Homo sapiens
gcaaucugcgagccaucuuc

SEQ ID NO: 3657 - RNA, 20 nt, Homo sapiens
caaucugcgagccaucuucu

SEQ ID NO: 3658 - RNA, 20 nt, Homo sapiens
aaucugcgagccaucuucuc

SEQ ID NO: 3659 - RNA, 20 nt, Homo sapiens
aucugcgagccaucuucucu

SEQ ID NO: 3660 - RNA, 20 nt, Homo sapiens
ucugcgagccaucuucucuu

SEQ ID NO: 3661 - RNA, 20 nt, Homo sapiens
cugcgagccaucuucucuuc

SEQ ID NO: 3662 - RNA, 20 nt, Homo sapiens
ugcgagccaucuucucuuca

SEQ ID NO: 3663 - RNA, 20 nt, Homo sapiens
gcgagccaucuucucuucau

SEQ ID NO: 3664 - RNA, 20 nt, Homo sapiens
cgagccaucuucucuucaua

SEQ ID NO: 3665 - RNA, 20 nt, Homo sapiens
gagccaucuucucuucauau

SEQ ID NO: 3666 - RNA, 20 nt, Homo sapiens
agccaucuucucuucauaug

SEQ ID NO: 3667 - RNA, 20 nt, Homo sapiens
gccaucuucucuucauaugu

SEQ ID NO: 3668 - RNA, 20 nt, Homo sapiens
ccaucuucucuucauauguu

SEQ ID NO: 3669 - RNA, 20 nt, Homo sapiens
caucuucucuucauauguua

SEQ ID NO: 3670 - RNA, 20 nt, Homo sapiens
aucuucucuucauauguuag

SEQ ID NO: 3671 - RNA, 20 nt, Homo sapiens
ucuucucuucauauguuaga

SEQ ID NO: 3672 - RNA, 20 nt, Homo sapiens
cuucucuucauauguuagac

SEQ ID NO: 3673 - RNA, 20 nt, Homo sapiens
uucucuucauauguuagacg

SEQ ID NO: 3674 - RNA, 20 nt, Homo sapiens
ucucuucauauguuagacgu

SEQ ID NO: 3675 - RNA, 20 nt, Homo sapiens
cucuucauauguuagacguu

SEQ ID NO: 3676 - RNA, 20 nt, Homo sapiens
ucuucauauguuagacguug

SEQ ID NO: 3677 - RNA, 20 nt, Homo sapiens
cuucauauguuagacguuga

SEQ ID NO: 3678 - RNA, 20 nt, Homo sapiens
uucauauguuagacguugau

SEQ ID NO: 3679 - RNA, 20 nt, Homo sapiens
ucauauguuagacguugauu

SEQ ID NO: 3680 - RNA, 20 nt, Homo sapiens
cauauguuagacguugauuu

SEQ ID NO: 3681 - RNA, 20 nt, Homo sapiens
auauguuagacguugauuuc

SEQ ID NO: 3682 - RNA, 20 nt, Homo sapiens
uauguuagacguugauuucc

SEQ ID NO: 3683 - RNA, 20 nt, Homo sapiens
auguuagacguugauuucca

SEQ ID NO: 3684 - RNA, 20 nt, Homo sapiens
uguuagacguugauuuccau

SEQ ID NO: 3685 - RNA, 20 nt, Homo sapiens
guuagacguugauuuccauu

SEQ ID NO: 3686 - RNA, 20 nt, Homo sapiens
uuagacguugauuuccauua

SEQ ID NO: 3687 - RNA, 20 nt, Homo sapiens
uagacguugauuuccauuau

SEQ ID NO: 3688 - RNA, 20 nt, Homo sapiens
agacguugauuuccauuaug

SEQ ID NO: 3689 - RNA, 20 nt, Homo sapiens
gacguugauuuccauuauga

SEQ ID NO: 3690 - RNA, 20 nt, Homo sapiens
acguugauuuccauuaugaa

SEQ ID NO: 3691 - RNA, 20 nt, Homo sapiens
cguugauuuccauuaugaag

SEQ ID NO: 3692 - RNA, 20 nt, Homo sapiens
guugauuuccauuaugaaga

SEQ ID NO: 3693 - RNA, 20 nt, Homo sapiens
uugauuuccauuaugaagaa

SEQ ID NO: 3694 - RNA, 20 nt, Homo sapiens
ugauuuccauuaugaagaag

SEQ ID NO: 3695 - RNA, 20 nt, Homo sapiens
gauuuccauuaugaagaagg

SEQ ID NO: 3696 - RNA, 20 nt, Homo sapiens
auuuccauuaugaagaaggg

SEQ ID NO: 3697 - RNA, 20 nt, Homo sapiens
uuuccauuaugaagaagggu

SEQ ID NO: 3698 - RNA, 20 nt, Homo sapiens
uuccauuaugaagaagggug

SEQ ID NO: 3699 - RNA, 20 nt, Homo sapiens
uccauuaugaagaagggugu

SEQ ID NO: 3700 - RNA, 20 nt, Homo sapiens
ccauuaugaagaaggguguc

SEQ ID NO: 3701 - RNA, 20 nt, Homo sapiens
cauuaugaagaagggugucc

SEQ ID NO: 3702 - RNA, 20 nt, Homo sapiens
auuaugaagaaggguguccu

SEQ ID NO: 3703 - RNA, 20 nt, Homo sapiens
uuaugaagaaggguguccuu

SEQ ID NO: 3704 - RNA, 20 nt, Homo sapiens
uaugaagaaggguguccuug

SEQ ID NO: 3705 - RNA, 20 nt, Homo sapiens
augaagaaggguguccuugc

SEQ ID NO: 3706 - RNA, 20 nt, Homo sapiens
ugaagaaggguguccuugca

SEQ ID NO: 3707 - RNA, 20 nt, Homo sapiens
gaagaaggguguccuugcau

SEQ ID NO: 3708 - RNA, 20 nt, Homo sapiens
aagaaggguguccuugcauu

SEQ ID NO: 3709 - RNA, 20 nt, Homo sapiens
agaaggguguccuugcauuu

SEQ ID NO: 3710 - RNA, 20 nt, Homo sapiens
gaaggguguccuugcauuuc

SEQ ID NO: 3711 - RNA, 20 nt, Homo sapiens
aaggguguccuugcauuuca

SEQ ID NO: 3712 - RNA, 20 nt, Homo sapiens
aggguguccuugcauuucag

SEQ ID NO: 3713 - RNA, 20 nt, Homo sapiens
ggguguccuugcauuucagc

SEQ ID NO: 3714 - RNA, 20 nt, Homo sapiens
gguguccuugcauuucagcu

SEQ ID NO: 3715 - RNA, 20 nt, Homo sapiens
guguccuugcauuucagcuu

SEQ ID NO: 3716 - RNA, 20 nt, Homo sapiens
uguccuugcauuucagcuuu

SEQ ID NO: 3717 - RNA, 20 nt, Homo sapiens
guccuugcauuucagcuuuc

SEQ ID NO: 3718 - RNA, 20 nt, Homo sapiens
uccuugcauuucagcuuucu

SEQ ID NO: 3719 - RNA, 20 nt, Homo sapiens
ccuugcauuucagcuuucuu

SEQ ID NO: 3720 - RNA, 20 nt, Homo sapiens
cuugcauuucagcuuucuuu

SEQ ID NO: 3721 - RNA, 20 nt, Homo sapiens
uugcauuucagcuuucuuuc

SEQ ID NO: 3722 - RNA, 20 nt, Homo sapiens
ugcauuucagcuuucuuucc

SEQ ID NO: 3723 - RNA, 20 nt, Homo sapiens
gcauuucagcuuucuuucca

SEQ ID NO: 3724 - RNA, 20 nt, Homo sapiens
cauuucagcuuucuuuccaa

SEQ ID NO: 3725 - RNA, 20 nt, Homo sapiens
auuucagcuuucuuuccaaa

SEQ ID NO: 3726 - RNA, 20 nt, Homo sapiens
uuucagcuuucuuuccaaau

SEQ ID NO: 3727 - RNA, 20 nt, Homo sapiens
uucagcuuucuuuccaaauc

SEQ ID NO: 3728 - RNA, 20 nt, Homo sapiens
ucagcuuucuuuccaaaucu

SEQ ID NO: 3729 - RNA, 20 nt, Homo sapiens
cagcuuucuuuccaaaucuu

SEQ ID NO: 3730 - RNA, 20 nt, Homo sapiens
agcuuucuuuccaaaucuug

SEQ ID NO: 3731 - RNA, 20 nt, Homo sapiens
gcuuucuuuccaaaucuuga

SEQ ID NO: 3732 - RNA, 20 nt, Homo sapiens
cuuucuuuccaaaucuugaa

SEQ ID NO: 3733 - RNA, 20 nt, Homo sapiens
uuucuuuccaaaucuugaau

SEQ ID NO: 3734 - RNA, 20 nt, Homo sapiens
uucuuuccaaaucuugaauc

SEQ ID NO: 3735 - RNA, 20 nt, Homo sapiens
ucuuuccaaaucuugaauca

SEQ ID NO: 3736 - RNA, 20 nt, Homo sapiens
cuuuccaaaucuugaaucaa

SEQ ID NO: 3737 - RNA, 20 nt, Homo sapiens
uuuccaaaucuugaaucaaa

SEQ ID NO: 3738 - RNA, 20 nt, Homo sapiens
uuccaaaucuugaaucaaag

SEQ ID NO: 3739 - RNA, 20 nt, Homo sapiens
uccaaaucuugaaucaaagc

SEQ ID NO: 3740 - RNA, 20 nt, Homo sapiens
ccaaaucuugaaucaaagcu

SEQ ID NO: 3741 - RNA, 20 nt, Homo sapiens
caaaucuugaaucaaagcuu

SEQ ID NO: 3742 - RNA, 20 nt, Homo sapiens
aaaucuugaaucaaagcuuc

SEQ ID NO: 3743 - RNA, 20 nt, Homo sapiens
aaucuugaaucaaagcuucu

SEQ ID NO: 3744 - RNA, 20 nt, Homo sapiens
aucuugaaucaaagcuucuu

SEQ ID NO: 3745 - RNA, 20 nt, Homo sapiens
ucuugaaucaaagcuucuuu

SEQ ID NO: 3746 - RNA, 20 nt, Homo sapiens
cuugaaucaaagcuucuuuu

SEQ ID NO: 3747 - RNA, 20 nt, Homo sapiens
uugaaucaaagcuucuuuug

SEQ ID NO: 3748 - RNA, 20 nt, Homo sapiens
ugaaucaaagcuucuuuuga

SEQ ID NO: 3749 - RNA, 20 nt, Homo sapiens
gaaucaaagcuucuuuugau

SEQ ID NO: 3750 - RNA, 20 nt, Homo sapiens
aaucaaagcuucuuuugauc

SEQ ID NO: 3751 - RNA, 20 nt, Homo sapiens
aucaaagcuucuuuugaucc

SEQ ID NO: 3752 - RNA, 20 nt, Homo sapiens
ucaaagcuucuuuugauccu

SEQ ID NO: 3753 - RNA, 20 nt, Homo sapiens
caaagcuucuuuugauccuu

SEQ ID NO: 3754 - RNA, 20 nt, Homo sapiens
aaagcuucuuuugauccuug

SEQ ID NO: 3755 - RNA, 20 nt, Homo sapiens
aagcuucuuuugauccuugu

SEQ ID NO: 3756 - RNA, 20 nt, Homo sapiens
agcuucuuuugauccuugua

SEQ ID NO: 3757 - RNA, 20 nt, Homo sapiens
gcuucuuuugauccuuguau

SEQ ID NO: 3758 - RNA, 20 nt, Homo sapiens
cuucuuuugauccuuguauu

SEQ ID NO: 3759 - RNA, 20 nt, Homo sapiens
uucuuuugauccuuguauuu

SEQ ID NO: 3760 - RNA, 20 nt, Homo sapiens
ucuuuugauccuuguauuuc

SEQ ID NO: 3761 - RNA, 20 nt, Homo sapiens
cuuuugauccuuguauuuca

SEQ ID NO: 3762 - RNA, 20 nt, Homo sapiens
uuuugauccuuguauuucau

SEQ ID NO: 3763 - RNA, 20 nt, Homo sapiens
uuugauccuuguauuucaug

SEQ ID NO: 3764 - RNA, 20 nt, Homo sapiens
uugauccuuguauuucauga

SEQ ID NO: 3765 - RNA, 20 nt, Homo sapiens
ugauccuuguauuucaugau

SEQ ID NO: 3766 - RNA, 20 nt, Homo sapiens
gauccuuguauuucaugauc

SEQ ID NO: 3767 - RNA, 20 nt, Homo sapiens
auccuuguauuucaugauca

SEQ ID NO: 3768 - RNA, 20 nt, Homo sapiens
uccuuguauuucaugaucag

SEQ ID NO: 3769 - RNA, 20 nt, Homo sapiens
ccuuguauuucaugaucagg

SEQ ID NO: 3770 - RNA, 20 nt, Homo sapiens
cuuguauuucaugaucagga

SEQ ID NO: 3771 - RNA, 20 nt, Homo sapiens
uuguauuucaugaucaggag

SEQ ID NO: 3772 - RNA, 20 nt, Homo sapiens
uguauuucaugaucaggagu

SEQ ID NO: 3773 - RNA, 20 nt, Homo sapiens
guauuucaugaucaggaguu

SEQ ID NO: 3774 - RNA, 20 nt, Homo sapiens
uauuucaugaucaggaguuc

SEQ ID NO: 3775 - RNA, 20 nt, Homo sapiens
auuucaugaucaggaguucu

SEQ ID NO: 3776 - RNA, 20 nt, Homo sapiens
uuucaugaucaggaguucuu

SEQ ID NO: 3777 - RNA, 20 nt, Homo sapiens
uucaugaucaggaguucuug

SEQ ID NO: 3778 - RNA, 20 nt, Homo sapiens
ucaugaucaggaguucuugg

SEQ ID NO: 3779 - RNA, 20 nt, Homo sapiens
caugaucaggaguucuuggu

SEQ ID NO: 3780 - RNA, 20 nt, Homo sapiens
augaucaggaguucuuggua

SEQ ID NO: 3781 - RNA, 20 nt, Homo sapiens
ugaucaggaguucuugguau

SEQ ID NO: 3782 - RNA, 20 nt, Homo sapiens
gaucaggaguucuugguaug

SEQ ID NO: 3783 - RNA, 20 nt, Homo sapiens
aucaggaguucuugguaugg

SEQ ID NO: 3784 - RNA, 20 nt, Homo sapiens
ucaggaguucuugguauggg

SEQ ID NO: 3785 - RNA, 20 nt, Homo sapiens
caggaguucuugguaugggc

SEQ ID NO: 3786 - RNA, 20 nt, Homo sapiens
aggaguucuugguaugggcu

SEQ ID NO: 3787 - RNA, 20 nt, Homo sapiens
ggaguucuugguaugggcuu

SEQ ID NO: 3788 - RNA, 20 nt, Homo sapiens
gaguucuugguaugggcuua

SEQ ID NO: 3789 - RNA, 20 nt, Homo sapiens
aguucuugguaugggcuuag

SEQ ID NO: 3790 - RNA, 20 nt, Homo sapiens
guucuugguaugggcuuagc

SEQ ID NO: 3791 - RNA, 20 nt, Homo sapiens
uucuugguaugggcuuagca

SEQ ID NO: 3792 - RNA, 20 nt, Homo sapiens
ucuugguaugggcuuagcau

SEQ ID NO: 3793 - RNA, 20 nt, Homo sapiens
cuugguaugggcuuagcauu

SEQ ID NO: 3794 - RNA, 20 nt, Homo sapiens
uugguaugggcuuagcauuu

SEQ ID NO: 3795 - RNA, 20 nt, Homo sapiens
ugguaugggcuuagcauuug

SEQ ID NO: 3796 - RNA, 20 nt, Homo sapiens
gguaugggcuuagcauuugc

SEQ ID NO: 3797 - RNA, 20 nt, Homo sapiens
guaugggcuuagcauuugca

SEQ ID NO: 3798 - RNA, 20 nt, Homo sapiens
uaugggcuuagcauuugcag

SEQ ID NO: 3799 - RNA, 20 nt, Homo sapiens
augggcuuagcauuugcagu

SEQ ID NO: 3800 - RNA, 20 nt, Homo sapiens
ugggcuuagcauuugcaguu

SEQ ID NO: 3801 - RNA, 20 nt, Homo sapiens
gggcuuagcauuugcaguuu

SEQ ID NO: 3802 - RNA, 20 nt, Homo sapiens
ggcuuagcauuugcaguuug

SEQ ID NO: 3803 - RNA, 20 nt, Homo sapiens
gcuuagcauuugcaguuugg

SEQ ID NO: 3804 - RNA, 20 nt, Homo sapiens
cuuagcauuugcaguuuggg

SEQ ID NO: 3805 - RNA, 20 nt, Homo sapiens
uuagcauuugcaguuuggga

SEQ ID NO: 3806 - RNA, 20 nt, Homo sapiens
uagcauuugcaguuugggau

SEQ ID NO: 3807 - RNA, 20 nt, Homo sapiens
agcauuugcaguuugggaug

SEQ ID NO: 3808 - RNA, 20 nt, Homo sapiens
gcauuugcaguuugggaugg

SEQ ID NO: 3809 - RNA, 20 nt, Homo sapiens
cauuugcaguuugggauggc

SEQ ID NO: 3810 - RNA, 20 nt, Homo sapiens
auuugcaguuugggauggcu

SEQ ID NO: 3811 - RNA, 20 nt, Homo sapiens
uuugcaguuugggauggcuu

SEQ ID NO: 3812 - RNA, 20 nt, Homo sapiens
uugcaguuugggauggcuuu

SEQ ID NO: 3813 - RNA, 20 nt, Homo sapiens
ugcaguuugggauggcuuug

SEQ ID NO: 3814 - RNA, 20 nt, Homo sapiens
gcaguuugggauggcuuugc

SEQ ID NO: 3815 - RNA, 20 nt, Homo sapiens
caguuugggauggcuuugca

SEQ ID NO: 3816 - RNA, 20 nt, Homo sapiens
aguuugggauggcuuugcau

SEQ ID NO: 3817 - RNA, 20 nt, Homo sapiens
guuugggauggcuuugcauu

SEQ ID NO: 3818 - RNA, 20 nt, Homo sapiens
uuugggauggcuuugcauuu

SEQ ID NO: 3819 - RNA, 20 nt, Homo sapiens
uugggauggcuuugcauuua

SEQ ID NO: 3820 - RNA, 20 nt, Homo sapiens
ugggauggcuuugcauuuau

SEQ ID NO: 3821 - RNA, 20 nt, Homo sapiens
gggauggcuuugcauuuaua

SEQ ID NO: 3822 - RNA, 20 nt, Homo sapiens
ggauggcuuugcauuuauag

SEQ ID NO: 3823 - RNA, 20 nt, Homo sapiens
gauggcuuugcauuuauagg

SEQ ID NO: 3824 - RNA, 20 nt, Homo sapiens
auggcuuugcauuuauaggu

SEQ ID NO: 3825 - RNA, 20 nt, Homo sapiens
uggcuuugcauuuauagguu

SEQ ID NO: 3826 - RNA, 20 nt, Homo sapiens
ggcuuugcauuuauagguug

SEQ ID NO: 3827 - RNA, 20 nt, Homo sapiens
gcuuugcauuuauagguugg

SEQ ID NO: 3828 - RNA, 20 nt, Homo sapiens
cuuugcauuuauagguuggc

SEQ ID NO: 3829 - RNA, 20 nt, Homo sapiens
uuugcauuuauagguuggcc

SEQ ID NO: 3830 - RNA, 20 nt, Homo sapiens
uugcauuuauagguuggcca

SEQ ID NO: 3831 - RNA, 20 nt, Homo sapiens
ugcauuuauagguuggccag

SEQ ID NO: 3832 - RNA, 20 nt, Homo sapiens
gcauuuauagguuggccagc

SEQ ID NO: 3833 - RNA, 20 nt, Homo sapiens
cauuuauagguuggccagcu

SEQ ID NO: 3834 - RNA, 20 nt, Homo sapiens
auuuauagguuggccagcug

SEQ ID NO: 3835 - RNA, 20 nt, Homo sapiens
uuuauagguuggccagcuga

SEQ ID NO: 3836 - RNA, 20 nt, Homo sapiens
uuauagguuggccagcugag

SEQ ID NO: 3837 - RNA, 20 nt, Homo sapiens
uauagguuggccagcugagg

SEQ ID NO: 3838 - RNA, 20 nt, Homo sapiens
auagguuggccagcugagga

SEQ ID NO: 3839 - RNA, 20 nt, Homo sapiens
uagguuggccagcugaggac

SEQ ID NO: 3840 - RNA, 20 nt, Homo sapiens
agguuggccagcugaggacu

SEQ ID NO: 3841 - RNA, 20 nt, Homo sapiens
gguuggccagcugaggacug

SEQ ID NO: 3842 - RNA, 20 nt, Homo sapiens
guuggccagcugaggacugu

SEQ ID NO: 3843 - RNA, 20 nt, Homo sapiens
uuggccagcugaggacuguu

SEQ ID NO: 3844 - RNA, 20 nt, Homo sapiens
uggccagcugaggacuguug

SEQ ID NO: 3845 - RNA, 20 nt, Homo sapiens
ggccagcugaggacuguuga

SEQ ID NO: 3846 - RNA, 20 nt, Homo sapiens
gccagcugaggacuguugau

SEQ ID NO: 3847 - RNA, 20 nt, Homo sapiens
ccagcugaggacuguugaua

SEQ ID NO: 3848 - RNA, 20 nt, Homo sapiens
cagcugaggacuguugauag

SEQ ID NO: 3849 - RNA, 20 nt, Homo sapiens
agcugaggacuguugauagu

SEQ ID NO: 3850 - RNA, 20 nt, Homo sapiens
gcugaggacuguugauaguu

SEQ ID NO: 3851 - RNA, 20 nt, Homo sapiens
cugaggacuguugauaguug

SEQ ID NO: 3852 - RNA, 20 nt, Homo sapiens
ugaggacuguugauaguugg

SEQ ID NO: 3853 - RNA, 20 nt, Homo sapiens
gaggacuguugauaguugga

SEQ ID NO: 3854 - RNA, 20 nt, Homo sapiens
aggacuguugauaguuggaa

SEQ ID NO: 3855 - RNA, 20 nt, Homo sapiens
ggacuguugauaguuggaau

SEQ ID NO: 3856 - RNA, 20 nt, Homo sapiens
gacuguugauaguuggaauc

SEQ ID NO: 3857 - RNA, 20 nt, Homo sapiens
acuguugauaguuggaaucc

SEQ ID NO: 3858 - RNA, 20 nt, Homo sapiens
cuguugauaguuggaaucca

SEQ ID NO: 3859 - RNA, 20 nt, Homo sapiens
uguugauaguuggaauccau

SEQ ID NO: 3860 - RNA, 20 nt, Homo sapiens
guugauaguuggaauccaua

SEQ ID NO: 3861 - RNA, 20 nt, Homo sapiens
uugauaguuggaauccauag

SEQ ID NO: 3862 - RNA, 20 nt, Homo sapiens
ugauaguuggaauccauagc

SEQ ID NO: 3863 - RNA, 20 nt, Homo sapiens
gauaguuggaauccauagcg

SEQ ID NO: 3864 - RNA, 20 nt, Homo sapiens
auaguuggaauccauagcgg

SEQ ID NO: 3865 - RNA, 20 nt, Homo sapiens
uaguuggaauccauagcgga

SEQ ID NO: 3866 - RNA, 20 nt, Homo sapiens
aguuggaauccauagcggaa

SEQ ID NO: 3867 - RNA, 20 nt, Homo sapiens
guuggaauccauagcggaag

SEQ ID NO: 3868 - RNA, 20 nt, Homo sapiens
uuggaauccauagcggaagg

SEQ ID NO: 3869 - RNA, 20 nt, Homo sapiens
uggaauccauagcggaaggg

SEQ ID NO: 3870 - RNA, 20 nt, Homo sapiens
ggaauccauagcggaaggga

SEQ ID NO: 3871 - RNA, 20 nt, Homo sapiens
gaauccauagcggaagggau

SEQ ID NO: 3872 - RNA, 20 nt, Homo sapiens
aauccauagcggaagggauu

SEQ ID NO: 3873 - RNA, 20 nt, Homo sapiens
auccauagcggaagggauuu

SEQ ID NO: 3874 - RNA, 20 nt, Homo sapiens
uccauagcggaagggauuuu

SEQ ID NO: 3875 - RNA, 20 nt, Homo sapiens
ccauagcggaagggauuuua

SEQ ID NO: 3876 - RNA, 20 nt, Homo sapiens
cauagcggaagggauuuuac

SEQ ID NO: 3877 - RNA, 20 nt, Homo sapiens
auagcggaagggauuuuacu

SEQ ID NO: 3878 - RNA, 20 nt, Homo sapiens
uagcggaagggauuuuacug

SEQ ID NO: 3879 - RNA, 20 nt, Homo sapiens
agcggaagggauuuuacugc

SEQ ID NO: 3880 - RNA, 20 nt, Homo sapiens
gcggaagggauuuuacugcu

SEQ ID NO: 3881 - RNA, 20 nt, Homo sapiens
cggaagggauuuuacugcua

SEQ ID NO: 3882 - RNA, 20 nt, Homo sapiens
ggaagggauuuuacugcuau

SEQ ID NO: 3883 - RNA, 20 nt, Homo sapiens
gaagggauuuuacugcuauu

SEQ ID NO: 3884 - RNA, 20 nt, Homo sapiens
aagggauuuuacugcuauug

SEQ ID NO: 3885 - RNA, 20 nt, Homo sapiens
agggauuuuacugcuauugu

SEQ ID NO: 3886 - RNA, 20 nt, Homo sapiens
gggauuuuacugcuauugua

SEQ ID NO: 3887 - RNA, 20 nt, Homo sapiens
ggauuuuacugcuauuguaa

SEQ ID NO: 3888 - RNA, 20 nt, Homo sapiens
gauuuuacugcuauuguaau

SEQ ID NO: 3889 - RNA, 20 nt, Homo sapiens
auuuuacugcuauuguaauc

SEQ ID NO: 3890 - RNA, 20 nt, Homo sapiens
uuuuacugcuauuguaauca

SEQ ID NO: 3891 - RNA, 20 nt, Homo sapiens
uuuacugcuauuguaaucag

SEQ ID NO: 3892 - RNA, 20 nt, Homo sapiens
uuacugcuauuguaaucagg

SEQ ID NO: 3893 - RNA, 20 nt, Homo sapiens
uacugcuauuguaaucaggc

SEQ ID NO: 3894 - RNA, 20 nt, Homo sapiens
acugcuauuguaaucaggcu

SEQ ID NO: 3895 - RNA, 20 nt, Homo sapiens
cugcuauuguaaucaggcug

SEQ ID NO: 3896 - RNA, 20 nt, Homo sapiens
ugcuauuguaaucaggcugu

SEQ ID NO: 3897 - RNA, 20 nt, Homo sapiens
gcuauuguaaucaggcugug

SEQ ID NO: 3898 - RNA, 20 nt, Homo sapiens
cuauuguaaucaggcuguga

SEQ ID NO: 3899 - RNA, 20 nt, Homo sapiens
uauuguaaucaggcugugau

SEQ ID NO: 3900 - RNA, 20 nt, Homo sapiens
auuguaaucaggcugugaug

SEQ ID NO: 3901 - RNA, 20 nt, Homo sapiens
uuguaaucaggcugugaugg

SEQ ID NO: 3902 - RNA, 20 nt, Homo sapiens
uguaaucaggcugugauggu

SEQ ID NO: 3903 - RNA, 20 nt, Homo sapiens
guaaucaggcugugauggua

SEQ ID NO: 3904 - RNA, 20 nt, Homo sapiens
uaaucaggcugugaugguaa

SEQ ID NO: 3905 - RNA, 20 nt, Homo sapiens
aaucaggcugugaugguaau

SEQ ID NO: 3906 - RNA, 20 nt, Homo sapiens
aucaggcugugaugguaaua

SEQ ID NO: 3907 - RNA, 20 nt, Homo sapiens
ucaggcugugaugguaauau

SEQ ID NO: 3908 - RNA, 20 nt, Homo sapiens
caggcugugaugguaauaug

SEQ ID NO: 3909 - RNA, 20 nt, Homo sapiens
aggcugugaugguaauaugg

SEQ ID NO: 3910 - RNA, 20 nt, Homo sapiens
ggcugugaugguaauaugga

SEQ ID NO: 3911 - RNA, 20 nt, Homo sapiens
gcugugaugguaauauggag

SEQ ID NO: 3912 - RNA, 20 nt, Homo sapiens
cugugaugguaauauggagc

SEQ ID NO: 3913 - RNA, 20 nt, Homo sapiens
ugugaugguaauauggagcu

SEQ ID NO: 3914 - RNA, 20 nt, Homo sapiens
gugaugguaauauggagcug

SEQ ID NO: 3915 - RNA, 20 nt, Homo sapiens
ugaugguaauauggagcuga

SEQ ID NO: 3916 - RNA, 20 nt, Homo sapiens
gaugguaauauggagcugag

SEQ ID NO: 3917 - RNA, 20 nt, Homo sapiens
augguaauauggagcugagg

SEQ ID NO: 3918 - RNA, 20 nt, Homo sapiens
ugguaauauggagcugagga

SEQ ID NO: 3919 - RNA, 20 nt, Homo sapiens
gguaauauggagcugaggaa

SEQ ID NO: 3920 - RNA, 20 nt, Homo sapiens
guaauauggagcugaggaag

SEQ ID NO: 3921 - RNA, 20 nt, Homo sapiens
uaauauggagcugaggaagc

SEQ ID NO: 3922 - RNA, 20 nt, Homo sapiens
aauauggagcugaggaagcu

SEQ ID NO: 3923 - RNA, 20 nt, Homo sapiens
auauggagcugaggaagcug

SEQ ID NO: 3924 - RNA, 20 nt, Homo sapiens
uauggagcugaggaagcugg

SEQ ID NO: 3925 - RNA, 20 nt, Homo sapiens
auggagcugaggaagcuggc

SEQ ID NO: 3926 - RNA, 20 nt, Homo sapiens
uggagcugaggaagcuggcu

SEQ ID NO: 3927 - RNA, 20 nt, Homo sapiens
ggagcugaggaagcuggcug

SEQ ID NO: 3928 - RNA, 20 nt, Homo sapiens
gagcugaggaagcuggcugg

SEQ ID NO: 3929 - RNA, 20 nt, Homo sapiens
agcugaggaagcuggcuggg

SEQ ID NO: 3930 - RNA, 20 nt, Homo sapiens
gcugaggaagcuggcugggg

SEQ ID NO: 3931 - RNA, 20 nt, Homo sapiens
cugaggaagcuggcugggga

SEQ ID NO: 3932 - RNA, 20 nt, Homo sapiens
ugaggaagcuggcuggggac

SEQ ID NO: 3933 - RNA, 20 nt, Homo sapiens
gaggaagcuggcuggggacu

SEQ ID NO: 3934 - RNA, 20 nt, Homo sapiens
aggaagcuggcuggggacug

SEQ ID NO: 3935 - RNA, 20 nt, Homo sapiens
ggaagcuggcuggggacugg

SEQ ID NO: 3936 - RNA, 20 nt, Homo sapiens
gaagcuggcuggggacuggu

SEQ ID NO: 3937 - RNA, 20 nt, Homo sapiens
aagcuggcuggggacugguu

SEQ ID NO: 3938 - RNA, 20 nt, Homo sapiens
agcuggcuggggacugguua

SEQ ID NO: 3939 - RNA, 20 nt, Homo sapiens
gcuggcuggggacugguuau

SEQ ID NO: 3940 - RNA, 20 nt, Homo sapiens
cuggcuggggacugguuaua

SEQ ID NO: 3941 - RNA, 20 nt, Homo sapiens
uggcuggggacugguuauag

SEQ ID NO: 3942 - RNA, 20 nt, Homo sapiens
ggcuggggacugguuauagg

SEQ ID NO: 3943 - RNA, 20 nt, Homo sapiens
gcuggggacugguuauaggu

SEQ ID NO: 3944 - RNA, 20 nt, Homo sapiens
cuggggacugguuauaggug

SEQ ID NO: 3945 - RNA, 20 nt, Homo sapiens
uggggacugguuauaggugg

SEQ ID NO: 3946 - RNA, 20 nt, Homo sapiens
ggggacugguuauagguggu

SEQ ID NO: 3947 - RNA, 20 nt, Homo sapiens
gggacugguuauaggugguu

SEQ ID NO: 3948 - RNA, 20 nt, Homo sapiens
ggacugguuauaggugguug

SEQ ID NO: 3949 - RNA, 20 nt, Homo sapiens
gacugguuauaggugguugu

SEQ ID NO: 3950 - RNA, 20 nt, Homo sapiens
acugguuauaggugguugua

SEQ ID NO: 3951 - RNA, 20 nt, Homo sapiens
cugguuauaggugguuguaa

SEQ ID NO: 3952 - RNA, 20 nt, Homo sapiens
ugguuauaggugguuguaac

SEQ ID NO: 3953 - RNA, 20 nt, Homo sapiens
gguuauaggugguuguaacc

SEQ ID NO: 3954 - RNA, 20 nt, Homo sapiens
guuauaggugguuguaaccc

SEQ ID NO: 3955 - RNA, 20 nt, Homo sapiens
uuauaggugguuguaacccu

SEQ ID NO: 3956 - RNA, 20 nt, Homo sapiens
uauaggugguuguaacccuu

SEQ ID NO: 3957 - RNA, 20 nt, Homo sapiens
auaggugguuguaacccuuu

SEQ ID NO: 3958 - RNA, 20 nt, Homo sapiens
uaggugguuguaacccuuug

SEQ ID NO: 3959 - RNA, 20 nt, Homo sapiens
aggugguuguaacccuuugg

SEQ ID NO: 3960 - RNA, 20 nt, Homo sapiens
ggugguuguaacccuuuggc

SEQ ID NO: 3961 - RNA, 20 nt, Homo sapiens
gugguuguaacccuuuggcc

SEQ ID NO: 3962 - RNA, 20 nt, Homo sapiens
ugguuguaacccuuuggccu

SEQ ID NO: 3963 - RNA, 20 nt, Homo sapiens
gguuguaacccuuuggccug

SEQ ID NO: 3964 - RNA, 20 nt, Homo sapiens
guuguaacccuuuggccugg

SEQ ID NO: 3965 - RNA, 20 nt, Homo sapiens
uuguaacccuuuggccuggg

SEQ ID NO: 3966 - RNA, 20 nt, Homo sapiens
uguaacccuuuggccugggu

SEQ ID NO: 3967 - RNA, 20 nt, Homo sapiens
guaacccuuuggccuggguu

SEQ ID NO: 3968 - RNA, 20 nt, Homo sapiens
uaacccuuuggccuggguug

SEQ ID NO: 3969 - RNA, 20 nt, Homo sapiens
aacccuuuggccuggguugg

SEQ ID NO: 3970 - RNA, 20 nt, Homo sapiens
acccuuuggccuggguugga

SEQ ID NO: 3971 - RNA, 20 nt, Homo sapiens
cccuuuggccuggguuggag

SEQ ID NO: 3972 - RNA, 20 nt, Homo sapiens
ccuuuggccuggguuggagc

SEQ ID NO: 3973 - RNA, 20 nt, Homo sapiens
cuuuggccuggguuggagcc

SEQ ID NO: 3974 - RNA, 20 nt, Homo sapiens
uuuggccuggguuggagcca

SEQ ID NO: 3975 - RNA, 20 nt, Homo sapiens
uuggccuggguuggagccag

SEQ ID NO: 3976 - RNA, 20 nt, Homo sapiens
uggccuggguuggagccagc

SEQ ID NO: 3977 - RNA, 20 nt, Homo sapiens
ggccuggguuggagccagca

SEQ ID NO: 3978 - RNA, 20 nt, Homo sapiens
gccuggguuggagccagcau

SEQ ID NO: 3979 - RNA, 20 nt, Homo sapiens
ccuggguuggagccagcaug

SEQ ID NO: 3980 - RNA, 20 nt, Homo sapiens
cuggguuggagccagcaugc

SEQ ID NO: 3981 - RNA, 20 nt, Homo sapiens
uggguuggagccagcaugcu

SEQ ID NO: 3982 - RNA, 20 nt, Homo sapiens
ggguuggagccagcaugcug

SEQ ID NO: 3983 - RNA, 20 nt, Homo sapiens
gguuggagccagcaugcugc

SEQ ID NO: 3984 - RNA, 20 nt, Homo sapiens
guuggagccagcaugcugcu

SEQ ID NO: 3985 - RNA, 20 nt, Homo sapiens
uuggagccagcaugcugcug

SEQ ID NO: 3986 - RNA, 20 nt, Homo sapiens
uggagccagcaugcugcugg

SEQ ID NO: 3987 - RNA, 20 nt, Homo sapiens
ggagccagcaugcugcuggg

SEQ ID NO: 3988 - RNA, 20 nt, Homo sapiens
gagccagcaugcugcugggg

SEQ ID NO: 3989 - RNA, 20 nt, Homo sapiens
agccagcaugcugcugggga

SEQ ID NO: 3990 - RNA, 20 nt, Homo sapiens
gccagcaugcugcuggggag

SEQ ID NO: 3991 - RNA, 20 nt, Homo sapiens
ccagcaugcugcuggggaga

SEQ ID NO: 3992 - RNA, 20 nt, Homo sapiens
cagcaugcugcuggggagaa

SEQ ID NO: 3993 - RNA, 20 nt, Homo sapiens
agcaugcugcuggggagaag

SEQ ID NO: 3994 - RNA, 20 nt, Homo sapiens
gcaugcugcuggggagaagc

SEQ ID NO: 3995 - RNA, 20 nt, Homo sapiens
caugcugcuggggagaagca

SEQ ID NO: 3996 - RNA, 20 nt, Homo sapiens
augcugcuggggagaagcag

SEQ ID NO: 3997 - RNA, 20 nt, Homo sapiens
ugcugcuggggagaagcagg

SEQ ID NO: 3998 - RNA, 20 nt, Homo sapiens
gcugcuggggagaagcaggg

SEQ ID NO: 3999 - RNA, 20 nt, Homo sapiens
cugcuggggagaagcaggga

SEQ ID NO: 4000 - RNA, 20 nt, Homo sapiens
ugcuggggagaagcagggaa

SEQ ID NO: 4001 - RNA, 20 nt, Homo sapiens
gcuggggagaagcagggaaa

SEQ ID NO: 4002 - RNA, 20 nt, Homo sapiens
cuggggagaagcagggaaag

SEQ ID NO: 4003 - RNA, 20 nt, Homo sapiens
uggggagaagcagggaaagc

SEQ ID NO: 4004 - RNA, 20 nt, Homo sapiens
ggggagaagcagggaaagca

SEQ ID NO: 4005 - RNA, 20 nt, Homo sapiens
gggagaagcagggaaagcag

SEQ ID NO: 4006 - RNA, 20 nt, Homo sapiens
ggagaagcagggaaagcaga

SEQ ID NO: 4007 - RNA, 20 nt, Homo sapiens
gagaagcagggaaagcagag

SEQ ID NO: 4008 - RNA, 20 nt, Homo sapiens
agaagcagggaaagcagagg

SEQ ID NO: 4009 - RNA, 20 nt, Homo sapiens
gaagcagggaaagcagagga

SEQ ID NO: 4010 - RNA, 20 nt, Homo sapiens
aagcagggaaagcagaggag

SEQ ID NO: 4011 - RNA, 20 nt, Homo sapiens
agcagggaaagcagaggagg

SEQ ID NO: 4012 - RNA, 20 nt, Homo sapiens
gcagggaaagcagaggagga

SEQ ID NO: 4013 - RNA, 20 nt, Homo sapiens
cagggaaagcagaggaggac

SEQ ID NO: 4014 - RNA, 20 nt, Homo sapiens
agggaaagcagaggaggaca

SEQ ID NO: 4015 - RNA, 20 nt, Homo sapiens
gggaaagcagaggaggacau

SEQ ID NO: 4016 - RNA, 20 nt, Homo sapiens
ggaaagcagaggaggacaug

SEQ ID NO: 4017 - RNA, 20 nt, Homo sapiens
gaaagcagaggaggacaugg

SEQ ID NO: 4018 - RNA, 20 nt, Homo sapiens
aaagcagaggaggacauggu

SEQ ID NO: 4019 - RNA, 20 nt, Homo sapiens
aagcagaggaggacauggug

SEQ ID NO: 4020 - RNA, 20 nt, Homo sapiens
agcagaggaggacaugguga

SEQ ID NO: 4021 - RNA, 20 nt, Homo sapiens
gcagaggaggacauggugau

SEQ ID NO: 4022 - RNA, 20 nt, Homo sapiens
cagaggaggacauggugaug

SEQ ID NO: 4023 - RNA, 20 nt, Homo sapiens
agaggaggacauggugaugu

SEQ ID NO: 4024 - RNA, 20 nt, Homo sapiens
gaggaggacauggugaugug

SEQ ID NO: 4025 - RNA, 20 nt, Homo sapiens
aggaggacauggugauguga

SEQ ID NO: 4026 - RNA, 20 nt, Homo sapiens
ggaggacauggugaugugag

SEQ ID NO: 4027 - RNA, 20 nt, Homo sapiens
gaggacauggugaugugaga

SEQ ID NO: 4028 - RNA, 20 nt, Homo sapiens
aggacauggugaugugagag

SEQ ID NO: 4029 - RNA, 20 nt, Homo sapiens
ggacauggugaugugagagc

SEQ ID NO: 4030 - RNA, 20 nt, Homo sapiens
gacauggugaugugagagcu

SEQ ID NO: 4031 - RNA, 20 nt, Homo sapiens
acauggugaugugagagcuc

SEQ ID NO: 4032 - RNA, 20 nt, Homo sapiens
cauggugaugugagagcuca

SEQ ID NO: 4033 - RNA, 20 nt, Homo sapiens
auggugaugugagagcucag

SEQ ID NO: 4034 - RNA, 20 nt, Homo sapiens
uggugaugugagagcucagu

SEQ ID NO: 4035 - RNA, 20 nt, Homo sapiens
ggugaugugagagcucagug

SEQ ID NO: 4036 - RNA, 20 nt, Homo sapiens
gugaugugagagcucagugu

SEQ ID NO: 4037 - RNA, 20 nt, Homo sapiens
ugaugugagagcucaguguu

SEQ ID NO: 4038 - RNA, 20 nt, Homo sapiens
gaugugagagcucaguguug

SEQ ID NO: 4039 - RNA, 20 nt, Homo sapiens
augugagagcucaguguuga

SEQ ID NO: 4040 - RNA, 20 nt, Homo sapiens
ugugagagcucaguguugag

SEQ ID NO: 4041 - RNA, 20 nt, Homo sapiens
gugagagcucaguguugagg

SEQ ID NO: 4042 - RNA, 20 nt, Homo sapiens
ugagagcucaguguugagga

SEQ ID NO: 4043 - RNA, 20 nt, Homo sapiens
gagagcucaguguugaggag

SEQ ID NO: 4044 - RNA, 20 nt, Homo sapiens
agagcucaguguugaggagg

SEQ ID NO: 4045 - RNA, 20 nt, Homo sapiens
gagcucaguguugaggaggc

SEQ ID NO: 4046 - RNA, 20 nt, Homo sapiens
agcucaguguugaggaggca

SEQ ID NO: 4047 - RNA, 20 nt, Homo sapiens
gcucaguguugaggaggcag

SEQ ID NO: 4048 - RNA, 20 nt, Homo sapiens
cucaguguugaggaggcaga

SEQ ID NO: 4049 - RNA, 20 nt, Homo sapiens
ucaguguugaggaggcagaa

SEQ ID NO: 4050 - RNA, 20 nt, Homo sapiens
caguguugaggaggcagaaa

SEQ ID NO: 4051 - RNA, 20 nt, Homo sapiens
aguguugaggaggcagaaaa

SEQ ID NO: 4052 - RNA, 20 nt, Homo sapiens
guguugaggaggcagaaaau

SEQ ID NO: 4053 - RNA, 20 nt, Homo sapiens
uguugaggaggcagaaaauc

SEQ ID NO: 4054 - RNA, 20 nt, Homo sapiens
guugaggaggcagaaaaucu

SEQ ID NO: 4055 - RNA, 20 nt, Homo sapiens
uugaggaggcagaaaaucuu

SEQ ID NO: 4056 - RNA, 20 nt, Homo sapiens
ugaggaggcagaaaaucuuu

SEQ ID NO: 4057 - RNA, 20 nt, Homo sapiens
gaggaggcagaaaaucuuug

SEQ ID NO: 4058 - RNA, 20 nt, Homo sapiens
aggaggcagaaaaucuuugc

SEQ ID NO: 4059 - RNA, 20 nt, Homo sapiens
ggaggcagaaaaucuuugcu

SEQ ID NO: 4060 - RNA, 20 nt, Homo sapiens
gaggcagaaaaucuuugcuc

SEQ ID NO: 4061 - RNA, 20 nt, Homo sapiens
aggcagaaaaucuuugcucu

SEQ ID NO: 4062 - RNA, 20 nt, Homo sapiens
ggcagaaaaucuuugcucug

SEQ ID NO: 4063 - RNA, 20 nt, Homo sapiens
gcagaaaaucuuugcucugu

SEQ ID NO: 4064 - RNA, 20 nt, Homo sapiens
cagaaaaucuuugcucugua

SEQ ID NO: 4065 - RNA, 20 nt, Homo sapiens
agaaaaucuuugcucuguac

SEQ ID NO: 4066 - RNA, 20 nt, Homo sapiens
gaaaaucuuugcucuguaca

SEQ ID NO: 4067 - RNA, 20 nt, Homo sapiens
aaaaucuuugcucuguacac

SEQ ID NO: 4068 - RNA, 20 nt, Homo sapiens
aaaucuuugcucuguacacu

SEQ ID NO: 4069 - RNA, 20 nt, Homo sapiens
aaucuuugcucuguacacug

SEQ ID NO: 4070 - RNA, 20 nt, Homo sapiens
aucuuugcucuguacacugg

SEQ ID NO: 4071 - RNA, 20 nt, Homo sapiens
ucuuugcucuguacacuggc

SEQ ID NO: 4072 - RNA, 20 nt, Homo sapiens
cuuugcucuguacacuggcg

SEQ ID NO: 4073 - RNA, 20 nt, Homo sapiens
uuugcucuguacacuggcgg

SEQ ID NO: 4074 - RNA, 20 nt, Homo sapiens
uugcucuguacacuggcggg

SEQ ID NO: 4075 - RNA, 20 nt, Homo sapiens
ugcucuguacacuggcgggg

SEQ ID NO: 4076 - RNA, 20 nt, Homo sapiens
gcucuguacacuggcggggc

SEQ ID NO: 4077 - RNA, 20 nt, Homo sapiens
cucuguacacuggcggggcu

SEQ ID NO: 4078 - RNA, 20 nt, Homo sapiens
ucuguacacuggcggggcug

SEQ ID NO: 4079 - RNA, 20 nt, Homo sapiens
cuguacacuggcggggcugg

SEQ ID NO: 4080 - RNA, 20 nt, Homo sapiens
uguacacuggcggggcugga

SEQ ID NO: 4081 - RNA, 20 nt, Homo sapiens
guacacuggcggggcuggau

SEQ ID NO: 4082 - RNA, 20 nt, Homo sapiens
uacacuggcggggcuggaug

SEQ ID NO: 4083 - RNA, 20 nt, Homo sapiens
acacuggcggggcuggauga

SEQ ID NO: 4084 - RNA, 20 nt, Homo sapiens
cacuggcggggcuggaugau

SEQ ID NO: 4085 - RNA, 20 nt, Homo sapiens
acuggcggggcuggaugaua

SEQ ID NO: 4086 - RNA, 20 nt, Homo sapiens
cuggcggggcuggaugauaa

SEQ ID NO: 4087 - RNA, 20 nt, Homo sapiens
uggcggggcuggaugauaau

SEQ ID NO: 4088 - RNA, 20 nt, Homo sapiens
ggcggggcuggaugauaaug

SEQ ID NO: 4089 - RNA, 20 nt, Homo sapiens
gcggggcuggaugauaaugg

SEQ ID NO: 4090 - RNA, 20 nt, Homo sapiens
cggggcuggaugauaaugga

SEQ ID NO: 4091 - RNA, 20 nt, Homo sapiens
ggggcuggaugauaauggaa

SEQ ID NO: 4092 - RNA, 20 nt, Homo sapiens
gggcuggaugauaauggaag

SEQ ID NO: 4093 - RNA, 20 nt, Homo sapiens
ggcuggaugauaauggaaga

SEQ ID NO: 4094 - RNA, 20 nt, Homo sapiens
gcuggaugauaauggaagac

SEQ ID NO: 4095 - RNA, 20 nt, Homo sapiens
cuggaugauaauggaagacu

SEQ ID NO: 4096 - RNA, 20 nt, Homo sapiens
uggaugauaauggaagacug

SEQ ID NO: 4097 - RNA, 20 nt, Homo sapiens
ggaugauaauggaagacugu

SEQ ID NO: 4098 - RNA, 20 nt, Homo sapiens
gaugauaauggaagacuguu

SEQ ID NO: 4099 - RNA, 20 nt, Homo sapiens
augauaauggaagacuguuu

SEQ ID NO: 4100 - RNA, 20 nt, Homo sapiens
ugauaauggaagacuguuug

SEQ ID NO: 4101 - RNA, 20 nt, Homo sapiens
gauaauggaagacuguuugg

SEQ ID NO: 4102 - RNA, 20 nt, Homo sapiens
auaauggaagacuguuuggu

SEQ ID NO: 4103 - RNA, 20 nt, Homo sapiens
uaauggaagacuguuugguc

SEQ ID NO: 4104 - RNA, 20 nt, Homo sapiens
aauggaagacuguuuggucu

SEQ ID NO: 4105 - RNA, 20 nt, Homo sapiens
auggaagacuguuuggucug

SEQ ID NO: 4106 - RNA, 20 nt, Homo sapiens
uggaagacuguuuggucugg

SEQ ID NO: 4107 - RNA, 20 nt, Homo sapiens
ggaagacuguuuggucuggc

SEQ ID NO: 4108 - RNA, 20 nt, Homo sapiens
gaagacuguuuggucuggcu

SEQ ID NO: 4109 - RNA, 20 nt, Homo sapiens
aagacuguuuggucuggcua

SEQ ID NO: 4110 - RNA, 20 nt, Homo sapiens
agacuguuuggucuggcuag

SEQ ID NO: 4111 - RNA, 20 nt, Homo sapiens
gacuguuuggucuggcuaga

SEQ ID NO: 4112 - RNA, 20 nt, Homo sapiens
acuguuuggucuggcuagag

SEQ ID NO: 4113 - RNA, 20 nt, Homo sapiens
cuguuuggucuggcuagaga

SEQ ID NO: 4114 - RNA, 20 nt, Homo sapiens
uguuuggucuggcuagagaa

SEQ ID NO: 4115 - RNA, 20 nt, Homo sapiens
guuuggucuggcuagagaag

SEQ ID NO: 4116 - RNA, 20 nt, Homo sapiens
uuuggucuggcuagagaagc

SEQ ID NO: 4117 - RNA, 20 nt, Homo sapiens
uuggucuggcuagagaagcu

SEQ ID NO: 4118 - RNA, 20 nt, Homo sapiens
uggucuggcuagagaagcug

SEQ ID NO: 4119 - RNA, 20 nt, Homo sapiens
ggucuggcuagagaagcugg

SEQ ID NO: 4120 - RNA, 20 nt, Homo sapiens
gucuggcuagagaagcugga

SEQ ID NO: 4121 - RNA, 20 nt, Homo sapiens
ucuggcuagagaagcuggag

SEQ ID NO: 4122 - RNA, 20 nt, Homo sapiens
cuggcuagagaagcuggagg

SEQ ID NO: 4123 - RNA, 20 nt, Homo sapiens
uggcuagagaagcuggaggu

SEQ ID NO: 4124 - RNA, 20 nt, Homo sapiens
ggcuagagaagcuggagguu

SEQ ID NO: 4125 - RNA, 20 nt, Homo sapiens
gcuagagaagcuggagguuu

SEQ ID NO: 4126 - RNA, 20 nt, Homo sapiens
cuagagaagcuggagguuuc

SEQ ID NO: 4127 - RNA, 20 nt, Homo sapiens
uagagaagcuggagguuucu

SEQ ID NO: 4128 - RNA, 20 nt, Homo sapiens
agagaagcuggagguuucug

SEQ ID NO: 4129 - RNA, 20 nt, Homo sapiens
gagaagcuggagguuucugg

SEQ ID NO: 4130 - RNA, 20 nt, Homo sapiens
agaagcuggagguuucuggu

SEQ ID NO: 4131 - RNA, 20 nt, Homo sapiens
gaagcuggagguuucugguc

SEQ ID NO: 4132 - RNA, 20 nt, Homo sapiens
aagcuggagguuucuggucc

SEQ ID NO: 4133 - RNA, 20 nt, Homo sapiens
agcuggagguuucuggucca

SEQ ID NO: 4134 - RNA, 20 nt, Homo sapiens
gcuggagguuucugguccag

SEQ ID NO: 4135 - RNA, 20 nt, Homo sapiens
cuggagguuucugguccagg

SEQ ID NO: 4136 - RNA, 20 nt, Homo sapiens
uggagguuucugguccagga

SEQ ID NO: 4137 - RNA, 20 nt, Homo sapiens
ggagguuucugguccaggag

SEQ ID NO: 4138 - RNA, 20 nt, Homo sapiens
gagguuucugguccaggagg

SEQ ID NO: 4139 - RNA, 20 nt, Homo sapiens
agguuucugguccaggaggc

SEQ ID NO: 4140 - RNA, 20 nt, Homo sapiens
gguuucugguccaggaggcu

SEQ ID NO: 4141 - RNA, 20 nt, Homo sapiens
guuucugguccaggaggcug

SEQ ID NO: 4142 - RNA, 20 nt, Homo sapiens
uuucugguccaggaggcugc

SEQ ID NO: 4143 - RNA, 20 nt, Homo sapiens
uucugguccaggaggcugca

SEQ ID NO: 4144 - RNA, 20 nt, Homo sapiens
ucugguccaggaggcugcaa

SEQ ID NO: 4145 - RNA, 20 nt, Homo sapiens
cugguccaggaggcugcaau

SEQ ID NO: 4146 - RNA, 20 nt, Homo sapiens
ugguccaggaggcugcaauc

SEQ ID NO: 4147 - RNA, 20 nt, Homo sapiens
gguccaggaggcugcaaucu

SEQ ID NO: 4148 - RNA, 20 nt, Homo sapiens
guccaggaggcugcaaucug

SEQ ID NO: 4149 - RNA, 20 nt, Homo sapiens
uccaggaggcugcaaucugg

SEQ ID NO: 4150 - RNA, 20 nt, Homo sapiens
ccaggaggcugcaaucugga

SEQ ID NO: 4151 - RNA, 20 nt, Homo sapiens
caggaggcugcaaucuggag

SEQ ID NO: 4152 - RNA, 20 nt, Homo sapiens
aggaggcugcaaucuggagc

SEQ ID NO: 4153 - RNA, 20 nt, Homo sapiens
ggaggcugcaaucuggagcc

SEQ ID NO: 4154 - RNA, 20 nt, Homo sapiens
gaggcugcaaucuggagcca

SEQ ID NO: 4155 - RNA, 20 nt, Homo sapiens
aggcugcaaucuggagccac

SEQ ID NO: 4156 - RNA, 20 nt, Homo sapiens
ggcugcaaucuggagccaca

SEQ ID NO: 4157 - RNA, 20 nt, Homo sapiens
gcugcaaucuggagccacau

SEQ ID NO: 4158 - RNA, 20 nt, Homo sapiens
cugcaaucuggagccacaug

SEQ ID NO: 4159 - RNA, 20 nt, Homo sapiens
ugcaaucuggagccacaugg

SEQ ID NO: 4160 - RNA, 20 nt, Homo sapiens
gcaaucuggagccacauggg

SEQ ID NO: 4161 - RNA, 20 nt, Homo sapiens
caaucuggagccacaugggu

SEQ ID NO: 4162 - RNA, 20 nt, Homo sapiens
aaucuggagccacauggguu

SEQ ID NO: 4163 - RNA, 20 nt, Homo sapiens
aucuggagccacauggguuu

SEQ ID NO: 4164 - RNA, 20 nt, Homo sapiens
ucuggagccacauggguuuu

SEQ ID NO: 4165 - RNA, 20 nt, Homo sapiens
cuggagccacauggguuuug

SEQ ID NO: 4166 - RNA, 20 nt, Homo sapiens
uggagccacauggguuuugg

SEQ ID NO: 4167 - RNA, 20 nt, Homo sapiens
ggagccacauggguuuuggg

SEQ ID NO: 4168 - RNA, 20 nt, Homo sapiens
gagccacauggguuuuggga

SEQ ID NO: 4169 - RNA, 20 nt, Homo sapiens
agccacauggguuuugggac

SEQ ID NO: 4170 - RNA, 20 nt, Homo sapiens
gccacauggguuuugggacu

SEQ ID NO: 4171 - RNA, 20 nt, Homo sapiens
ccacauggguuuugggacug

SEQ ID NO: 4172 - RNA, 20 nt, Homo sapiens
cacauggguuuugggacugg

SEQ ID NO: 4173 - RNA, 20 nt, Homo sapiens
acauggguuuugggacugga

SEQ ID NO: 4174 - RNA, 20 nt, Homo sapiens
cauggguuuugggacuggau

SEQ ID NO: 4175 - RNA, 20 nt, Homo sapiens
auggguuuugggacuggaug

SEQ ID NO: 4176 - RNA, 20 nt, Homo sapiens
uggguuuugggacuggauga

SEQ ID NO: 4177 - RNA, 20 nt, Homo sapiens
ggguuuugggacuggaugaa

SEQ ID NO: 4178 - RNA, 20 nt, Homo sapiens
gguuuugggacuggaugaag

SEQ ID NO: 4179 - RNA, 20 nt, Homo sapiens
guuuugggacuggaugaagu

SEQ ID NO: 4180 - RNA, 20 nt, Homo sapiens
uuuugggacuggaugaagug

SEQ ID NO: 4181 - RNA, 20 nt, Homo sapiens
uuugggacuggaugaagugu

SEQ ID NO: 4182 - RNA, 20 nt, Homo sapiens
uugggacuggaugaaguguu

SEQ ID NO: 4183 - RNA, 20 nt, Homo sapiens
ugggacuggaugaaguguuu

SEQ ID NO: 4184 - RNA, 20 nt, Homo sapiens
gggacuggaugaaguguuuu

SEQ ID NO: 4185 - RNA, 20 nt, Homo sapiens
ggacuggaugaaguguuuug

SEQ ID NO: 4186 - RNA, 20 nt, Homo sapiens
gacuggaugaaguguuuugg

SEQ ID NO: 4187 - RNA, 20 nt, Homo sapiens
acuggaugaaguguuuugga

SEQ ID NO: 4188 - RNA, 20 nt, Homo sapiens
cuggaugaaguguuuuggac

SEQ ID NO: 4189 - RNA, 20 nt, Homo sapiens
uggaugaaguguuuuggacg

SEQ ID NO: 4190 - RNA, 20 nt, Homo sapiens
ggaugaaguguuuuggacgu

SEQ ID NO: 4191 - RNA, 20 nt, Homo sapiens
gaugaaguguuuuggacguu

SEQ ID NO: 4192 - RNA, 20 nt, Homo sapiens
augaaguguuuuggacguuc

SEQ ID NO: 4193 - RNA, 20 nt, Homo sapiens
ugaaguguuuuggacguucg

SEQ ID NO: 4194 - RNA, 20 nt, Homo sapiens
gaaguguuuuggacguucgu

SEQ ID NO: 4195 - RNA, 20 nt, Homo sapiens
aaguguuuuggacguucgua

SEQ ID NO: 4196 - RNA, 20 nt, Homo sapiens
aguguuuuggacguucguag

SEQ ID NO: 4197 - RNA, 20 nt, Homo sapiens
guguuuuggacguucguagu

SEQ ID NO: 4198 - RNA, 20 nt, Homo sapiens
uguuuuggacguucguaguu

SEQ ID NO: 4199 - RNA, 20 nt, Homo sapiens
guuuuggacguucguaguua

SEQ ID NO: 4200 - RNA, 20 nt, Homo sapiens
uuuuggacguucguaguuaa

SEQ ID NO: 4201 - RNA, 20 nt, Homo sapiens
uuuggacguucguaguuaaa

SEQ ID NO: 4202 - RNA, 20 nt, Homo sapiens
uuggacguucguaguuaaac

SEQ ID NO: 4203 - RNA, 20 nt, Homo sapiens
uggacguucguaguuaaaca

SEQ ID NO: 4204 - RNA, 20 nt, Homo sapiens
ggacguucguaguuaaacau

SEQ ID NO: 4205 - RNA, 20 nt, Homo sapiens
gacguucguaguuaaacaug

SEQ ID NO: 4206 - RNA, 20 nt, Homo sapiens
acguucguaguuaaacaugc

SEQ ID NO: 4207 - RNA, 20 nt, Homo sapiens
cguucguaguuaaacaugcu

SEQ ID NO: 4208 - RNA, 20 nt, Homo sapiens
guucguaguuaaacaugcuu

SEQ ID NO: 4209 - RNA, 20 nt, Homo sapiens
uucguaguuaaacaugcuua

SEQ ID NO: 4210 - RNA, 20 nt, Homo sapiens
ucguaguuaaacaugcuuag

SEQ ID NO: 4211 - RNA, 20 nt, Homo sapiens
cguaguuaaacaugcuuagu

SEQ ID NO: 4212 - RNA, 20 nt, Homo sapiens
guaguuaaacaugcuuaguu

SEQ ID NO: 4213 - RNA, 20 nt, Homo sapiens
uaguuaaacaugcuuaguug

SEQ ID NO: 4214 - RNA, 20 nt, Homo sapiens
aguuaaacaugcuuaguugg

SEQ ID NO: 4215 - RNA, 20 nt, Homo sapiens
guuaaacaugcuuaguuggu

SEQ ID NO: 4216 - RNA, 20 nt, Homo sapiens
uuaaacaugcuuaguuggua

SEQ ID NO: 4217 - RNA, 20 nt, Homo sapiens
uaaacaugcuuaguugguau

SEQ ID NO: 4218 - RNA, 20 nt, Homo sapiens
aaacaugcuuaguugguaua

SEQ ID NO: 4219 - RNA, 20 nt, Homo sapiens
aacaugcuuaguugguauau

SEQ ID NO: 4220 - RNA, 20 nt, Homo sapiens
acaugcuuaguugguauaug

SEQ ID NO: 4221 - RNA, 20 nt, Homo sapiens
caugcuuaguugguauaugg

SEQ ID NO: 4222 - RNA, 20 nt, Homo sapiens
augcuuaguugguauaugga

SEQ ID NO: 4223 - RNA, 20 nt, Homo sapiens
ugcuuaguugguauauggaa

SEQ ID NO: 4224 - RNA, 20 nt, Homo sapiens
gcuuaguugguauauggaag

SEQ ID NO: 4225 - RNA, 20 nt, Homo sapiens
cuuaguugguauauggaaga

SEQ ID NO: 4226 - RNA, 20 nt, Homo sapiens
uuaguugguauauggaagau

SEQ ID NO: 4227 - RNA, 20 nt, Homo sapiens
uaguugguauauggaagaug

SEQ ID NO: 4228 - RNA, 20 nt, Homo sapiens
aguugguauauggaagauga

SEQ ID NO: 4229 - RNA, 20 nt, Homo sapiens
guugguauauggaagaugaa

SEQ ID NO: 4230 - RNA, 20 nt, Homo sapiens
uugguauauggaagaugaag

SEQ ID NO: 4231 - RNA, 20 nt, Homo sapiens
ugguauauggaagaugaagg

SEQ ID NO: 4232 - RNA, 20 nt, Homo sapiens
gguauauggaagaugaaggc

SEQ ID NO: 4233 - RNA, 20 nt, Homo sapiens
guauauggaagaugaaggca

SEQ ID NO: 4234 - RNA, 20 nt, Homo sapiens
uauauggaagaugaaggcaa

SEQ ID NO: 4235 - RNA, 20 nt, Homo sapiens
auauggaagaugaaggcaaa

SEQ ID NO: 4236 - RNA, 20 nt, Homo sapiens
uauggaagaugaaggcaaau

SEQ ID NO: 4237 - RNA, 20 nt, Homo sapiens
auggaagaugaaggcaaauu

SEQ ID NO: 4238 - RNA, 20 nt, Homo sapiens
uggaagaugaaggcaaauua

SEQ ID NO: 4239 - RNA, 20 nt, Homo sapiens
ggaagaugaaggcaaauuau

SEQ ID NO: 4240 - RNA, 20 nt, Homo sapiens
gaagaugaaggcaaauuauu

SEQ ID NO: 4241 - RNA, 20 nt, Homo sapiens
aagaugaaggcaaauuauua

SEQ ID NO: 4242 - RNA, 20 nt, Homo sapiens
agaugaaggcaaauuauuac

SEQ ID NO: 4243 - RNA, 20 nt, Homo sapiens
gaugaaggcaaauuauuacu

SEQ ID NO: 4244 - RNA, 20 nt, Homo sapiens
augaaggcaaauuauuacua

SEQ ID NO: 4245 - RNA, 20 nt, Homo sapiens
ugaaggcaaauuauuacuau

SEQ ID NO: 4246 - RNA, 20 nt, Homo sapiens
gaaggcaaauuauuacuaua

SEQ ID NO: 4247 - RNA, 20 nt, Homo sapiens
aaggcaaauuauuacuauaa

SEQ ID NO: 4248 - RNA, 20 nt, Homo sapiens
aggcaaauuauuacuauaau

SEQ ID NO: 4249 - RNA, 20 nt, Homo sapiens
ggcaaauuauuacuauaaug

SEQ ID NO: 4250 - RNA, 20 nt, Homo sapiens
gcaaauuauuacuauaauga

SEQ ID NO: 4251 - RNA, 20 nt, Homo sapiens
caaauuauuacuauaaugau

SEQ ID NO: 4252 - RNA, 20 nt, Homo sapiens
aaauuauuacuauaaugauu

SEQ ID NO: 4253 - RNA, 20 nt, Homo sapiens
aauuauuacuauaaugauuu

SEQ ID NO: 4254 - RNA, 20 nt, Homo sapiens
auuauuacuauaaugauuug

SEQ ID NO: 4255 - RNA, 20 nt, Homo sapiens
uuauuacuauaaugauuugu

SEQ ID NO: 4256 - RNA, 20 nt, Homo sapiens
uauuacuauaaugauuuguu

SEQ ID NO: 4257 - RNA, 20 nt, Homo sapiens
auuacuauaaugauuuguuc

SEQ ID NO: 4258 - RNA, 20 nt, Homo sapiens
uuacuauaaugauuuguucc

SEQ ID NO: 4259 - RNA, 20 nt, Homo sapiens
uacuauaaugauuuguuccu

SEQ ID NO: 4260 - RNA, 20 nt, Homo sapiens
acuauaaugauuuguuccug

SEQ ID NO: 4261 - RNA, 20 nt, Homo sapiens
cuauaaugauuuguuccugg

SEQ ID NO: 4262 - RNA, 20 nt, Homo sapiens
uauaaugauuuguuccugga

SEQ ID NO: 4263 - RNA, 20 nt, Homo sapiens
auaaugauuuguuccuggaa

SEQ ID NO: 4264 - RNA, 20 nt, Homo sapiens
uaaugauuuguuccuggaag

SEQ ID NO: 4265 - RNA, 20 nt, Homo sapiens
aaugauuuguuccuggaagg

SEQ ID NO: 4266 - RNA, 20 nt, Homo sapiens
augauuuguuccuggaaggg

SEQ ID NO: 4267 - RNA, 20 nt, Homo sapiens
ugauuuguuccuggaagggu

SEQ ID NO: 4268 - RNA, 20 nt, Homo sapiens
gauuuguuccuggaagggug

SEQ ID NO: 4269 - RNA, 20 nt, Homo sapiens
auuuguuccuggaagggugg

SEQ ID NO: 4270 - RNA, 20 nt, Homo sapiens
uuuguuccuggaaggguggg

SEQ ID NO: 4271 - RNA, 20 nt, Homo sapiens
uuguuccuggaagggugggg

SEQ ID NO: 4272 - RNA, 20 nt, Homo sapiens
uguuccuggaaggguggggc

SEQ ID NO: 4273 - RNA, 20 nt, Homo sapiens
guuccuggaaggguggggcc

SEQ ID NO: 4274 - RNA, 20 nt, Homo sapiens
uuccuggaaggguggggccc

SEQ ID NO: 4275 - RNA, 20 nt, Homo sapiens
uccuggaaggguggggcccu

SEQ ID NO: 4276 - RNA, 20 nt, Homo sapiens
ccuggaaggguggggcccug

SEQ ID NO: 4277 - RNA, 20 nt, Homo sapiens
cuggaaggguggggcccuga

SEQ ID NO: 4278 - RNA, 20 nt, Homo sapiens
uggaaggguggggcccugaa

SEQ ID NO: 4279 - RNA, 20 nt, Homo sapiens
ggaaggguggggcccugaau

SEQ ID NO: 4280 - RNA, 20 nt, Homo sapiens
gaaggguggggcccugaauu

SEQ ID NO: 4281 - RNA, 20 nt, Homo sapiens
aaggguggggcccugaauuu

SEQ ID NO: 4282 - RNA, 20 nt, Homo sapiens
aggguggggcccugaauuug

SEQ ID NO: 4283 - RNA, 20 nt, Homo sapiens
ggguggggcccugaauuugg

SEQ ID NO: 4284 - RNA, 20 nt, Homo sapiens
gguggggcccugaauuuggg

SEQ ID NO: 4285 - RNA, 20 nt, Homo sapiens
guggggcccugaauuugggg

SEQ ID NO: 4286 - RNA, 20 nt, Homo sapiens
uggggcccugaauuuggggc

SEQ ID NO: 4287 - RNA, 20 nt, Homo sapiens
ggggcccugaauuuggggcc

SEQ ID NO: 4288 - RNA, 20 nt, Homo sapiens
gggcccugaauuuggggcca

SEQ ID NO: 4289 - RNA, 20 nt, Homo sapiens
ggcccugaauuuggggccac

SEQ ID NO: 4290 - RNA, 20 nt, Homo sapiens
gcccugaauuuggggccaca

SEQ ID NO: 4291 - RNA, 20 nt, Homo sapiens
cccugaauuuggggccacaa

SEQ ID NO: 4292 - RNA, 20 nt, Homo sapiens
ccugaauuuggggccacaag

SEQ ID NO: 4293 - RNA, 20 nt, Homo sapiens
cugaauuuggggccacaagc

SEQ ID NO: 4294 - RNA, 20 nt, Homo sapiens
ugaauuuggggccacaagcc

SEQ ID NO: 4295 - RNA, 20 nt, Homo sapiens
gaauuuggggccacaagccu

SEQ ID NO: 4296 - RNA, 20 nt, Homo sapiens
aauuuggggccacaagccug

SEQ ID NO: 4297 - RNA, 20 nt, Homo sapiens
auuuggggccacaagccugg

SEQ ID NO: 4298 - RNA, 20 nt, Homo sapiens
uuuggggccacaagccugga

SEQ ID NO: 4299 - RNA, 20 nt, Homo sapiens
uuggggccacaagccuggaa

SEQ ID NO: 4300 - RNA, 20 nt, Homo sapiens
uggggccacaagccuggaau

SEQ ID NO: 4301 - RNA, 20 nt, Homo sapiens
ggggccacaagccuggaauu

SEQ ID NO: 4302 - RNA, 20 nt, Homo sapiens
gggccacaagccuggaauua

SEQ ID NO: 4303 - RNA, 20 nt, Homo sapiens
ggccacaagccuggaauuac

SEQ ID NO: 4304 - RNA, 20 nt, Homo sapiens
gccacaagccuggaauuacg

SEQ ID NO: 4305 - RNA, 20 nt, Homo sapiens
ccacaagccuggaauuacgg

SEQ ID NO: 4306 - RNA, 20 nt, Homo sapiens
cacaagccuggaauuacgga

SEQ ID NO: 4307 - RNA, 20 nt, Homo sapiens
acaagccuggaauuacggaa

SEQ ID NO: 4308 - RNA, 20 nt, Homo sapiens
caagccuggaauuacggaag

SEQ ID NO: 4309 - RNA, 20 nt, Homo sapiens
aagccuggaauuacggaagg

SEQ ID NO: 4310 - RNA, 20 nt, Homo sapiens
agccuggaauuacggaaggu

SEQ ID NO: 4311 - RNA, 20 nt, Homo sapiens
gccuggaauuacggaagguu

SEQ ID NO: 4312 - RNA, 20 nt, Homo sapiens
ccuggaauuacggaagguug

SEQ ID NO: 4313 - RNA, 20 nt, Homo sapiens
cuggaauuacggaagguugu

SEQ ID NO: 4314 - RNA, 20 nt, Homo sapiens
uggaauuacggaagguugua

SEQ ID NO: 4315 - RNA, 20 nt, Homo sapiens
ggaauuacggaagguuguaa

SEQ ID NO: 4316 - RNA, 20 nt, Homo sapiens
gaauuacggaagguuguaag

SEQ ID NO: 4317 - RNA, 20 nt, Homo sapiens
aauuacggaagguuguaagg

SEQ ID NO: 4318 - RNA, 20 nt, Homo sapiens
auuacggaagguuguaagga

SEQ ID NO: 4319 - RNA, 20 nt, Homo sapiens
uuacggaagguuguaaggaa

SEQ ID NO: 4320 - RNA, 20 nt, Homo sapiens
uacggaagguuguaaggaau

SEQ ID NO: 4321 - RNA, 20 nt, Homo sapiens
acggaagguuguaaggaauc

SEQ ID NO: 4322 - RNA, 20 nt, Homo sapiens
cggaagguuguaaggaauca

SEQ ID NO: 4323 - RNA, 20 nt, Homo sapiens
ggaagguuguaaggaaucag

SEQ ID NO: 4324 - RNA, 20 nt, Homo sapiens
gaagguuguaaggaaucaga

SEQ ID NO: 4325 - RNA, 20 nt, Homo sapiens
aagguuguaaggaaucagaa

SEQ ID NO: 4326 - RNA, 20 nt, Homo sapiens
agguuguaaggaaucagaag

SEQ ID NO: 4327 - RNA, 20 nt, Homo sapiens
gguuguaaggaaucagaagc

SEQ ID NO: 4328 - RNA, 20 nt, Homo sapiens
guuguaaggaaucagaagca

SEQ ID NO: 4329 - RNA, 20 nt, Homo sapiens
uuguaaggaaucagaagcaa

SEQ ID NO: 4330 - RNA, 20 nt, Homo sapiens
uguaaggaaucagaagcaac

SEQ ID NO: 4331 - RNA, 20 nt, Homo sapiens
guaaggaaucagaagcaacc

SEQ ID NO: 4332 - RNA, 20 nt, Homo sapiens
uaaggaaucagaagcaaccu

SEQ ID NO: 4333 - RNA, 20 nt, Homo sapiens
aaggaaucagaagcaaccuu

SEQ ID NO: 4334 - RNA, 20 nt, Homo sapiens
aggaaucagaagcaaccuug

SEQ ID NO: 4335 - RNA, 20 nt, Homo sapiens
ggaaucagaagcaaccuugg

SEQ ID NO: 4336 - RNA, 20 nt, Homo sapiens
gaaucagaagcaaccuuggu

SEQ ID NO: 4337 - RNA, 20 nt, Homo sapiens
aaucagaagcaaccuugguc

SEQ ID NO: 4338 - RNA, 20 nt, Homo sapiens
aucagaagcaaccuuggucu

SEQ ID NO: 4339 - RNA, 20 nt, Homo sapiens
ucagaagcaaccuuggucug

SEQ ID NO: 4340 - RNA, 20 nt, Homo sapiens
cagaagcaaccuuggucugc

SEQ ID NO: 4341 - RNA, 20 nt, Homo sapiens
agaagcaaccuuggucugcu

SEQ ID NO: 4342 - RNA, 20 nt, Homo sapiens
gaagcaaccuuggucugcuc

SEQ ID NO: 4343 - RNA, 20 nt, Homo sapiens
aagcaaccuuggucugcucu

SEQ ID NO: 4344 - RNA, 20 nt, Homo sapiens
agcaaccuuggucugcucuu

SEQ ID NO: 4345 - RNA, 20 nt, Homo sapiens
gcaaccuuggucugcucuuc

SEQ ID NO: 4346 - RNA, 20 nt, Homo sapiens
caaccuuggucugcucuucc

SEQ ID NO: 4347 - RNA, 20 nt, Homo sapiens
aaccuuggucugcucuuccu

SEQ ID NO: 4348 - RNA, 20 nt, Homo sapiens
accuuggucugcucuuccuu

SEQ ID NO: 4349 - RNA, 20 nt, Homo sapiens
ccuuggucugcucuuccuug

SEQ ID NO: 4350 - RNA, 20 nt, Homo sapiens
cuuggucugcucuuccuugu

SEQ ID NO: 4351 - RNA, 20 nt, Homo sapiens
uuggucugcucuuccuuguu

SEQ ID NO: 4352 - RNA, 20 nt, Homo sapiens
uggucugcucuuccuuguug

SEQ ID NO: 4353 - RNA, 20 nt, Homo sapiens
ggucugcucuuccuuguuga

SEQ ID NO: 4354 - RNA, 20 nt, Homo sapiens
gucugcucuuccuuguugag

SEQ ID NO: 4355 - RNA, 20 nt, Homo sapiens
ucugcucuuccuuguugaga

SEQ ID NO: 4356 - RNA, 20 nt, Homo sapiens
cugcucuuccuuguugagau

SEQ ID NO: 4357 - RNA, 20 nt, Homo sapiens
ugcucuuccuuguugagauc

SEQ ID NO: 4358 - RNA, 20 nt, Homo sapiens
gcucuuccuuguugagaucc

SEQ ID NO: 4359 - RNA, 20 nt, Homo sapiens
cucuuccuuguugagauccu

SEQ ID NO: 4360 - RNA, 20 nt, Homo sapiens
ucuuccuuguugagauccug

SEQ ID NO: 4361 - RNA, 20 nt, Homo sapiens
cuuccuuguugagauccuga

SEQ ID NO: 4362 - RNA, 20 nt, Homo sapiens
uuccuuguugagauccugag

SEQ ID NO: 4363 - RNA, 20 nt, Homo sapiens
uccuuguugagauccugaga

SEQ ID NO: 4364 - RNA, 20 nt, Homo sapiens
ccuuguugagauccugagaa

SEQ ID NO: 4365 - RNA, 20 nt, Homo sapiens
cuuguugagauccugagaau

SEQ ID NO: 4366 - RNA, 20 nt, Homo sapiens
uuguugagauccugagaaua

SEQ ID NO: 4367 - RNA, 20 nt, Homo sapiens
uguugagauccugagaauac

SEQ ID NO: 4368 - RNA, 20 nt, Homo sapiens
guugagauccugagaauacu

SEQ ID NO: 4369 - RNA, 20 nt, Homo sapiens
uugagauccugagaauacug

SEQ ID NO: 4370 - RNA, 20 nt, Homo sapiens
ugagauccugagaauacugu

SEQ ID NO: 4371 - RNA, 20 nt, Homo sapiens
gagauccugagaauacugug

SEQ ID NO: 4372 - RNA, 20 nt, Homo sapiens
agauccugagaauacugugc

SEQ ID NO: 4373 - RNA, 20 nt, Homo sapiens
gauccugagaauacugugcu

SEQ ID NO: 4374 - RNA, 20 nt, Homo sapiens
auccugagaauacugugcuc

SEQ ID NO: 4375 - RNA, 20 nt, Homo sapiens
uccugagaauacugugcucc

SEQ ID NO: 4376 - RNA, 20 nt, Homo sapiens
ccugagaauacugugcuccu

SEQ ID NO: 4377 - RNA, 20 nt, Homo sapiens
cugagaauacugugcuccug

SEQ ID NO: 4378 - RNA, 20 nt, Homo sapiens
ugagaauacugugcuccugg

SEQ ID NO: 4379 - RNA, 20 nt, Homo sapiens
gagaauacugugcuccuggc

SEQ ID NO: 4380 - RNA, 20 nt, Homo sapiens
agaauacugugcuccuggcu

SEQ ID NO: 4381 - RNA, 20 nt, Homo sapiens
gaauacugugcuccuggcuu

SEQ ID NO: 4382 - RNA, 20 nt, Homo sapiens
aauacugugcuccuggcuuu

SEQ ID NO: 4383 - RNA, 20 nt, Homo sapiens
auacugugcuccuggcuuug

SEQ ID NO: 4384 - RNA, 20 nt, Homo sapiens
uacugugcuccuggcuuugg

SEQ ID NO: 4385 - RNA, 20 nt, Homo sapiens
acugugcuccuggcuuuggu

SEQ ID NO: 4386 - RNA, 20 nt, Homo sapiens
cugugcuccuggcuuuggua

SEQ ID NO: 4387 - RNA, 20 nt, Homo sapiens
ugugcuccuggcuuugguag

SEQ ID NO: 4388 - RNA, 20 nt, Homo sapiens
gugcuccuggcuuugguaga

SEQ ID NO: 4389 - RNA, 20 nt, Homo sapiens
ugcuccuggcuuugguagag

SEQ ID NO: 4390 - RNA, 20 nt, Homo sapiens
gcuccuggcuuugguagagu

SEQ ID NO: 4391 - RNA, 20 nt, Homo sapiens
cuccuggcuuugguagagug

SEQ ID NO: 4392 - RNA, 20 nt, Homo sapiens
uccuggcuuugguagaguga

SEQ ID NO: 4393 - RNA, 20 nt, Homo sapiens
ccuggcuuugguagagugac

SEQ ID NO: 4394 - RNA, 20 nt, Homo sapiens
cuggcuuugguagagugacc

SEQ ID NO: 4395 - RNA, 20 nt, Homo sapiens
uggcuuugguagagugaccu

SEQ ID NO: 4396 - RNA, 20 nt, Homo sapiens
ggcuuugguagagugaccuu

SEQ ID NO: 4397 - RNA, 20 nt, Homo sapiens
gcuuugguagagugaccuuc

SEQ ID NO: 4398 - RNA, 20 nt, Homo sapiens
cuuugguagagugaccuucu

SEQ ID NO: 4399 - RNA, 20 nt, Homo sapiens
uuugguagagugaccuucuc

SEQ ID NO: 4400 - RNA, 20 nt, Homo sapiens
uugguagagugaccuucucu

SEQ ID NO: 4401 - RNA, 20 nt, Homo sapiens
ugguagagugaccuucucuu

SEQ ID NO: 4402 - RNA, 20 nt, Homo sapiens
gguagagugaccuucucuug

SEQ ID NO: 4403 - RNA, 20 nt, Homo sapiens
guagagugaccuucucuuga

SEQ ID NO: 4404 - RNA, 20 nt, Homo sapiens
uagagugaccuucucuugaa

SEQ ID NO: 4405 - RNA, 20 nt, Homo sapiens
agagugaccuucucuugaag

SEQ ID NO: 4406 - RNA, 20 nt, Homo sapiens
gagugaccuucucuugaaga

SEQ ID NO: 4407 - RNA, 20 nt, Homo sapiens
agugaccuucucuugaagaa

SEQ ID NO: 4408 - RNA, 20 nt, Homo sapiens
gugaccuucucuugaagaau

SEQ ID NO: 4409 - RNA, 20 nt, Homo sapiens
ugaccuucucuugaagaaua

SEQ ID NO: 4410 - RNA, 20 nt, Homo sapiens
gaccuucucuugaagaauau

SEQ ID NO: 4411 - RNA, 20 nt, Homo sapiens
accuucucuugaagaauauu

SEQ ID NO: 4412 - RNA, 20 nt, Homo sapiens
ccuucucuugaagaauauug

SEQ ID NO: 4413 - RNA, 20 nt, Homo sapiens
cuucucuugaagaauauugu

SEQ ID NO: 4414 - RNA, 20 nt, Homo sapiens
uucucuugaagaauauuguu

SEQ ID NO: 4415 - RNA, 20 nt, Homo sapiens
ucucuugaagaauauuguuc

SEQ ID NO: 4416 - RNA, 20 nt, Homo sapiens
cucuugaagaauauuguucc

SEQ ID NO: 4417 - RNA, 20 nt, Homo sapiens
ucuugaagaauauuguuccc

SEQ ID NO: 4418 - RNA, 20 nt, Homo sapiens
cuugaagaauauuguucccg

SEQ ID NO: 4419 - RNA, 20 nt, Homo sapiens
uugaagaauauuguucccgu

SEQ ID NO: 4420 - RNA, 20 nt, Homo sapiens
ugaagaauauuguucccgua

SEQ ID NO: 4421 - RNA, 20 nt, Homo sapiens
gaagaauauuguucccguag

SEQ ID NO: 4422 - RNA, 20 nt, Homo sapiens
aagaauauuguucccguagu

SEQ ID NO: 4423 - RNA, 20 nt, Homo sapiens
agaauauuguucccguaguu

SEQ ID NO: 4424 - RNA, 20 nt, Homo sapiens
gaauauuguucccguaguuc

SEQ ID NO: 4425 - RNA, 20 nt, Homo sapiens
aauauuguucccguaguucc

SEQ ID NO: 4426 - RNA, 20 nt, Homo sapiens
auauuguucccguaguucca

SEQ ID NO: 4427 - RNA, 20 nt, Homo sapiens
uauuguucccguaguuccag

SEQ ID NO: 4428 - RNA, 20 nt, Homo sapiens
auuguucccguaguuccaga

SEQ ID NO: 4429 - RNA, 20 nt, Homo sapiens
uuguucccguaguuccagag

SEQ ID NO: 4430 - RNA, 20 nt, Homo sapiens
uguucccguaguuccagagg

SEQ ID NO: 4431 - RNA, 20 nt, Homo sapiens
guucccguaguuccagaggg

SEQ ID NO: 4432 - RNA, 20 nt, Homo sapiens
uucccguaguuccagagggu

SEQ ID NO: 4433 - RNA, 20 nt, Homo sapiens
ucccguaguuccagagggug

SEQ ID NO: 4434 - RNA, 20 nt, Homo sapiens
cccguaguuccagagggugc

SEQ ID NO: 4435 - RNA, 20 nt, Homo sapiens
ccguaguuccagagggugcc

SEQ ID NO: 4436 - RNA, 20 nt, Homo sapiens
cguaguuccagagggugcca

SEQ ID NO: 4437 - RNA, 20 nt, Homo sapiens
guaguuccagagggugccag

SEQ ID NO: 4438 - RNA, 20 nt, Homo sapiens
uaguuccagagggugccagc

SEQ ID NO: 4439 - RNA, 20 nt, Homo sapiens
aguuccagagggugccagcu

SEQ ID NO: 4440 - RNA, 20 nt, Homo sapiens
guuccagagggugccagcug

SEQ ID NO: 4441 - RNA, 20 nt, Homo sapiens
uuccagagggugccagcugg

SEQ ID NO: 4442 - RNA, 20 nt, Homo sapiens
uccagagggugccagcuggg

SEQ ID NO: 4443 - RNA, 20 nt, Homo sapiens
ccagagggugccagcugggu

SEQ ID NO: 4444 - RNA, 20 nt, Homo sapiens
cagagggugccagcuggguu

SEQ ID NO: 4445 - RNA, 20 nt, Homo sapiens
agagggugccagcuggguuu

SEQ ID NO: 4446 - RNA, 20 nt, Homo sapiens
gagggugccagcuggguuua

SEQ ID NO: 4447 - RNA, 20 nt, Homo sapiens
agggugccagcuggguuuaa

SEQ ID NO: 4448 - RNA, 20 nt, Homo sapiens
gggugccagcuggguuuaac

SEQ ID NO: 4449 - RNA, 20 nt, Homo sapiens
ggugccagcuggguuuaacc

SEQ ID NO: 4450 - RNA, 20 nt, Homo sapiens
gugccagcuggguuuaaccc

SEQ ID NO: 4451 - RNA, 20 nt, Homo sapiens
ugccagcuggguuuaaccca

SEQ ID NO: 4452 - RNA, 20 nt, Homo sapiens
gccagcuggguuuaacccac

SEQ ID NO: 4453 - RNA, 20 nt, Homo sapiens
ccagcuggguuuaacccacu

SEQ ID NO: 4454 - RNA, 20 nt, Homo sapiens
cagcuggguuuaacccacua

SEQ ID NO: 4455 - RNA, 20 nt, Homo sapiens
agcuggguuuaacccacuau

SEQ ID NO: 4456 - RNA, 20 nt, Homo sapiens
gcuggguuuaacccacuauu

SEQ ID NO: 4457 - RNA, 20 nt, Homo sapiens
cuggguuuaacccacuauug

SEQ ID NO: 4458 - RNA, 20 nt, Homo sapiens
uggguuuaacccacuauuga

SEQ ID NO: 4459 - RNA, 20 nt, Homo sapiens
ggguuuaacccacuauugaa

SEQ ID NO: 4460 - RNA, 20 nt, Homo sapiens
gguuuaacccacuauugaag

SEQ ID NO: 4461 - RNA, 20 nt, Homo sapiens
guuuaacccacuauugaagg

SEQ ID NO: 4462 - RNA, 20 nt, Homo sapiens
uuuaacccacuauugaaggg

SEQ ID NO: 4463 - RNA, 20 nt, Homo sapiens
uuaacccacuauugaaggga

SEQ ID NO: 4464 - RNA, 20 nt, Homo sapiens
uaacccacuauugaagggaa

SEQ ID NO: 4465 - RNA, 20 nt, Homo sapiens
aacccacuauugaagggaag

SEQ ID NO: 4466 - RNA, 20 nt, Homo sapiens
acccacuauugaagggaagg

SEQ ID NO: 4467 - RNA, 20 nt, Homo sapiens
cccacuauugaagggaagga

SEQ ID NO: 4468 - RNA, 20 nt, Homo sapiens
ccacuauugaagggaaggaa

SEQ ID NO: 4469 - RNA, 20 nt, Homo sapiens
cacuauugaagggaaggaag

SEQ ID NO: 4470 - RNA, 20 nt, Homo sapiens
acuauugaagggaaggaaga

SEQ ID NO: 4471 - RNA, 20 nt, Homo sapiens
cuauugaagggaaggaagag

SEQ ID NO: 4472 - RNA, 20 nt, Homo sapiens
uauugaagggaaggaagagg

SEQ ID NO: 4473 - RNA, 20 nt, Homo sapiens
auugaagggaaggaagaggc

SEQ ID NO: 4474 - RNA, 20 nt, Homo sapiens
uugaagggaaggaagaggca

SEQ ID NO: 4475 - RNA, 20 nt, Homo sapiens
ugaagggaaggaagaggcau

SEQ ID NO: 4476 - RNA, 20 nt, Homo sapiens
gaagggaaggaagaggcauc

SEQ ID NO: 4477 - RNA, 20 nt, Homo sapiens
aagggaaggaagaggcaucu

SEQ ID NO: 4478 - RNA, 20 nt, Homo sapiens
agggaaggaagaggcaucuc

SEQ ID NO: 4479 - RNA, 20 nt, Homo sapiens
gggaaggaagaggcaucucc

SEQ ID NO: 4480 - RNA, 20 nt, Homo sapiens
ggaaggaagaggcaucuccu

SEQ ID NO: 4481 - RNA, 20 nt, Homo sapiens
gaaggaagaggcaucuccuu

SEQ ID NO: 4482 - RNA, 20 nt, Homo sapiens
aaggaagaggcaucuccuuc

SEQ ID NO: 4483 - RNA, 20 nt, Homo sapiens
aggaagaggcaucuccuucc

SEQ ID NO: 4484 - RNA, 20 nt, Homo sapiens
ggaagaggcaucuccuuccc

SEQ ID NO: 4485 - RNA, 20 nt, Homo sapiens
gaagaggcaucuccuucccu

SEQ ID NO: 4486 - RNA, 20 nt, Homo sapiens
aagaggcaucuccuucccuc

SEQ ID NO: 4487 - RNA, 20 nt, Homo sapiens
agaggcaucuccuucccuca

SEQ ID NO: 4488 - RNA, 20 nt, Homo sapiens
gaggcaucuccuucccucac

SEQ ID NO: 4489 - RNA, 20 nt, Homo sapiens
aggcaucuccuucccucaca

SEQ ID NO: 4490 - RNA, 20 nt, Homo sapiens
ggcaucuccuucccucacag

SEQ ID NO: 4491 - RNA, 20 nt, Homo sapiens
gcaucuccuucccucacaga

SEQ ID NO: 4492 - RNA, 20 nt, Homo sapiens
caucuccuucccucacagac

SEQ ID NO: 4493 - RNA, 20 nt, Homo sapiens
aucuccuucccucacagacu

SEQ ID NO: 4494 - RNA, 20 nt, Homo sapiens
ucuccuucccucacagacua

SEQ ID NO: 4495 - RNA, 20 nt, Homo sapiens
cuccuucccucacagacuaa

SEQ ID NO: 4496 - RNA, 20 nt, Homo sapiens
uccuucccucacagacuaau

SEQ ID NO: 4497 - RNA, 20 nt, Homo sapiens
ccuucccucacagacuaauc

SEQ ID NO: 4498 - RNA, 20 nt, Homo sapiens
cuucccucacagacuaaucu

SEQ ID NO: 4499 - RNA, 20 nt, Homo sapiens
uucccucacagacuaaucua

SEQ ID NO: 4500 - RNA, 20 nt, Homo sapiens
ucccucacagacuaaucuag

SEQ ID NO: 4501 - RNA, 20 nt, Homo sapiens
cccucacagacuaaucuagu

SEQ ID NO: 4502 - RNA, 20 nt, Homo sapiens
ccucacagacuaaucuagug

SEQ ID NO: 4503 - RNA, 20 nt, Homo sapiens
cucacagacuaaucuagugg

SEQ ID NO: 4504 - RNA, 20 nt, Homo sapiens
ucacagacuaaucuaguggc

SEQ ID NO: 4505 - RNA, 20 nt, Homo sapiens
cacagacuaaucuaguggcu

SEQ ID NO: 4506 - RNA, 20 nt, Homo sapiens
acagacuaaucuaguggcuc

SEQ ID NO: 4507 - RNA, 20 nt, Homo sapiens
cagacuaaucuaguggcucu

SEQ ID NO: 4508 - RNA, 20 nt, Homo sapiens
agacuaaucuaguggcucug

SEQ ID NO: 4509 - RNA, 20 nt, Homo sapiens
gacuaaucuaguggcucugu

SEQ ID NO: 4510 - RNA, 20 nt, Homo sapiens
acuaaucuaguggcucugug

SEQ ID NO: 4511 - RNA, 20 nt, Homo sapiens
cuaaucuaguggcucugugc

SEQ ID NO: 4512 - RNA, 20 nt, Homo sapiens
uaaucuaguggcucugugcu

SEQ ID NO: 4513 - RNA, 20 nt, Homo sapiens
aaucuaguggcucugugcuu

SEQ ID NO: 4514 - RNA, 21 nt, Homo sapiens
uccguuuuaaauauuugaauu

SEQ ID NO: 4515 - RNA, 21 nt, Homo sapiens
ccguuuuaaauauuugaauuu

SEQ ID NO: 4516 - RNA, 21 nt, Homo sapiens
cguuuuaaauauuugaauuuu

SEQ ID NO: 4517 - RNA, 21 nt, Homo sapiens
guuuuaaauauuugaauuuua

SEQ ID NO: 4518 - RNA, 21 nt, Homo sapiens
uuuuaaauauuugaauuuuau

SEQ ID NO: 4519 - RNA, 21 nt, Homo sapiens
uuuaaauauuugaauuuuauu

SEQ ID NO: 4520 - RNA, 21 nt, Homo sapiens
uuaaauauuugaauuuuauuu

SEQ ID NO: 4521 - RNA, 21 nt, Homo sapiens
uaaauauuugaauuuuauuuu

SEQ ID NO: 4522 - RNA, 21 nt, Homo sapiens
aaauauuugaauuuuauuuuc

SEQ ID NO: 4523 - RNA, 21 nt, Homo sapiens
aauauuugaauuuuauuuucu

SEQ ID NO: 4524 - RNA, 21 nt, Homo sapiens
auauuugaauuuuauuuucuu

SEQ ID NO: 4525 - RNA, 21 nt, Homo sapiens
uauuugaauuuuauuuucuuu

SEQ ID NO: 4526 - RNA, 21 nt, Homo sapiens
auuugaauuuuauuuucuuuu

SEQ ID NO: 4527 - RNA, 21 nt, Homo sapiens
uuugaauuuuauuuucuuuug

SEQ ID NO: 4528 - RNA, 21 nt, Homo sapiens
uugaauuuuauuuucuuuuga

SEQ ID NO: 4529 - RNA, 21 nt, Homo sapiens
ugaauuuuauuuucuuuugac

SEQ ID NO: 4530 - RNA, 21 nt, Homo sapiens
gaauuuuauuuucuuuugaca

SEQ ID NO: 4531 - RNA, 21 nt, Homo sapiens
aauuuuauuuucuuuugacau

SEQ ID NO: 4532 - RNA, 21 nt, Homo sapiens
auuuuauuuucuuuugacaua

SEQ ID NO: 4533 - RNA, 21 nt, Homo sapiens
uuuuauuuucuuuugacauac

SEQ ID NO: 4534 - RNA, 21 nt, Homo sapiens
uuuauuuucuuuugacauaca

SEQ ID NO: 4535 - RNA, 21 nt, Homo sapiens
uuauuuucuuuugacauacaa

SEQ ID NO: 4536 - RNA, 21 nt, Homo sapiens
uauuuucuuuugacauacaac

SEQ ID NO: 4537 - RNA, 21 nt, Homo sapiens
auuuucuuuugacauacaacu

SEQ ID NO: 4538 - RNA, 21 nt, Homo sapiens
uuuucuuuugacauacaacug

SEQ ID NO: 4539 - RNA, 21 nt, Homo sapiens
uuucuuuugacauacaacugu

SEQ ID NO: 4540 - RNA, 21 nt, Homo sapiens
uucuuuugacauacaacugug

SEQ ID NO: 4541 - RNA, 21 nt, Homo sapiens
ucuuuugacauacaacugugg

SEQ ID NO: 4542 - RNA, 21 nt, Homo sapiens
cuuuugacauacaacugugga

SEQ ID NO: 4543 - RNA, 21 nt, Homo sapiens
uuuugacauacaacuguggaa

SEQ ID NO: 4544 - RNA, 21 nt, Homo sapiens
uuugacauacaacuguggaac

SEQ ID NO: 4545 - RNA, 21 nt, Homo sapiens
uugacauacaacuguggaaca

SEQ ID NO: 4546 - RNA, 21 nt, Homo sapiens
ugacauacaacuguggaacac

SEQ ID NO: 4547 - RNA, 21 nt, Homo sapiens
gacauacaacuguggaacacu

SEQ ID NO: 4548 - RNA, 21 nt, Homo sapiens
acauacaacuguggaacacuc

SEQ ID NO: 4549 - RNA, 21 nt, Homo sapiens
cauacaacuguggaacacuca

SEQ ID NO: 4550 - RNA, 21 nt, Homo sapiens
auacaacuguggaacacucag

SEQ ID NO: 4551 - RNA, 21 nt, Homo sapiens
uacaacuguggaacacucaga

SEQ ID NO: 4552 - RNA, 21 nt, Homo sapiens
acaacuguggaacacucagau

SEQ ID NO: 4553 - RNA, 21 nt, Homo sapiens
caacuguggaacacucagaua

SEQ ID NO: 4554 - RNA, 21 nt, Homo sapiens
aacuguggaacacucagauaa

SEQ ID NO: 4555 - RNA, 21 nt, Homo sapiens
acuguggaacacucagauaau

SEQ ID NO: 4556 - RNA, 21 nt, Homo sapiens
cuguggaacacucagauaauc

SEQ ID NO: 4557 - RNA, 21 nt, Homo sapiens
uguggaacacucagauaaucu

SEQ ID NO: 4558 - RNA, 21 nt, Homo sapiens
guggaacacucagauaaucua

SEQ ID NO: 4559 - RNA, 21 nt, Homo sapiens
uggaacacucagauaaucuau

SEQ ID NO: 4560 - RNA, 21 nt, Homo sapiens
ggaacacucagauaaucuaua

SEQ ID NO: 4561 - RNA, 21 nt, Homo sapiens
gaacacucagauaaucuauac

SEQ ID NO: 4562 - RNA, 21 nt, Homo sapiens
aacacucagauaaucuauacc

SEQ ID NO: 4563 - RNA, 21 nt, Homo sapiens
acacucagauaaucuauacca

SEQ ID NO: 4564 - RNA, 21 nt, Homo sapiens
cacucagauaaucuauaccau

SEQ ID NO: 4565 - RNA, 21 nt, Homo sapiens
acucagauaaucuauaccaug

SEQ ID NO: 4566 - RNA, 21 nt, Homo sapiens
cucagauaaucuauaccaugu

SEQ ID NO: 4567 - RNA, 21 nt, Homo sapiens
ucagauaaucuauaccauguu

SEQ ID NO: 4568 - RNA, 21 nt, Homo sapiens
cagauaaucuauaccauguua

SEQ ID NO: 4569 - RNA, 21 nt, Homo sapiens
agauaaucuauaccauguuag

SEQ ID NO: 4570 - RNA, 21 nt, Homo sapiens
gauaaucuauaccauguuagu

SEQ ID NO: 4571 - RNA, 21 nt, Homo sapiens
auaaucuauaccauguuagua

SEQ ID NO: 4572 - RNA, 21 nt, Homo sapiens
uaaucuauaccauguuaguau

SEQ ID NO: 4573 - RNA, 21 nt, Homo sapiens
aaucuauaccauguuaguauu

SEQ ID NO: 4574 - RNA, 21 nt, Homo sapiens
aucuauaccauguuaguauuc

SEQ ID NO: 4575 - RNA, 21 nt, Homo sapiens
ucuauaccauguuaguauucc

SEQ ID NO: 4576 - RNA, 21 nt, Homo sapiens
cuauaccauguuaguauuccu

SEQ ID NO: 4577 - RNA, 21 nt, Homo sapiens
uauaccauguuaguauuccua

SEQ ID NO: 4578 - RNA, 21 nt, Homo sapiens
auaccauguuaguauuccuac

SEQ ID NO: 4579 - RNA, 21 nt, Homo sapiens
uaccauguuaguauuccuaca

SEQ ID NO: 4580 - RNA, 21 nt, Homo sapiens
accauguuaguauuccuacaa

SEQ ID NO: 4581 - RNA, 21 nt, Homo sapiens
ccauguuaguauuccuacaag

SEQ ID NO: 4582 - RNA, 21 nt, Homo sapiens
cauguuaguauuccuacaaga

SEQ ID NO: 4583 - RNA, 21 nt, Homo sapiens
auguuaguauuccuacaagag

SEQ ID NO: 4584 - RNA, 21 nt, Homo sapiens
uguuaguauuccuacaagaga

SEQ ID NO: 4585 - RNA, 21 nt, Homo sapiens
guuaguauuccuacaagagaa

SEQ ID NO: 4586 - RNA, 21 nt, Homo sapiens
uuaguauuccuacaagagaaa

SEQ ID NO: 4587 - RNA, 21 nt, Homo sapiens
uaguauuccuacaagagaaaa

SEQ ID NO: 4588 - RNA, 21 nt, Homo sapiens
aguauuccuacaagagaaaac

SEQ ID NO: 4589 - RNA, 21 nt, Homo sapiens
guauuccuacaagagaaaacg

SEQ ID NO: 4590 - RNA, 21 nt, Homo sapiens
uauuccuacaagagaaaacgg

SEQ ID NO: 4591 - RNA, 21 nt, Homo sapiens
auuccuacaagagaaaacggg

SEQ ID NO: 4592 - RNA, 21 nt, Homo sapiens
uuccuacaagagaaaacgggu

SEQ ID NO: 4593 - RNA, 21 nt, Homo sapiens
uccuacaagagaaaacgggua

SEQ ID NO: 4594 - RNA, 21 nt, Homo sapiens
ccuacaagagaaaacggguaa

SEQ ID NO: 4595 - RNA, 21 nt, Homo sapiens
cuacaagagaaaacggguaaa

SEQ ID NO: 4596 - RNA, 21 nt, Homo sapiens
uacaagagaaaacggguaaaa

SEQ ID NO: 4597 - RNA, 21 nt, Homo sapiens
acaagagaaaacggguaaaac

SEQ ID NO: 4598 - RNA, 21 nt, Homo sapiens
caagagaaaacggguaaaaca

SEQ ID NO: 4599 - RNA, 21 nt, Homo sapiens
aagagaaaacggguaaaacag

SEQ ID NO: 4600 - RNA, 21 nt, Homo sapiens
agagaaaacggguaaaacagu

SEQ ID NO: 4601 - RNA, 21 nt, Homo sapiens
gagaaaacggguaaaacagua

SEQ ID NO: 4602 - RNA, 21 nt, Homo sapiens
agaaaacggguaaaacaguau

SEQ ID NO: 4603 - RNA, 21 nt, Homo sapiens
gaaaacggguaaaacaguauu

SEQ ID NO: 4604 - RNA, 21 nt, Homo sapiens
aaaacggguaaaacaguauuu

SEQ ID NO: 4605 - RNA, 21 nt, Homo sapiens
aaacggguaaaacaguauuua

SEQ ID NO: 4606 - RNA, 21 nt, Homo sapiens
aacggguaaaacaguauuuag

SEQ ID NO: 4607 - RNA, 21 nt, Homo sapiens
acggguaaaacaguauuuaga

SEQ ID NO: 4608 - RNA, 21 nt, Homo sapiens
cggguaaaacaguauuuagaa

SEQ ID NO: 4609 - RNA, 21 nt, Homo sapiens
ggguaaaacaguauuuagaaa

SEQ ID NO: 4610 - RNA, 21 nt, Homo sapiens
gguaaaacaguauuuagaaag

SEQ ID NO: 4611 - RNA, 21 nt, Homo sapiens
guaaaacaguauuuagaaagc

SEQ ID NO: 4612 - RNA, 21 nt, Homo sapiens
uaaaacaguauuuagaaagca

SEQ ID NO: 4613 - RNA, 21 nt, Homo sapiens
aaaacaguauuuagaaagcag

SEQ ID NO: 4614 - RNA, 21 nt, Homo sapiens
aaacaguauuuagaaagcagu

SEQ ID NO: 4615 - RNA, 21 nt, Homo sapiens
aacaguauuuagaaagcagua

SEQ ID NO: 4616 - RNA, 21 nt, Homo sapiens
acaguauuuagaaagcaguac

SEQ ID NO: 4617 - RNA, 21 nt, Homo sapiens
caguauuuagaaagcaguacc

SEQ ID NO: 4618 - RNA, 21 nt, Homo sapiens
aguauuuagaaagcaguacca

SEQ ID NO: 4619 - RNA, 21 nt, Homo sapiens
guauuuagaaagcaguaccag

SEQ ID NO: 4620 - RNA, 21 nt, Homo sapiens
uauuuagaaagcaguaccagu

SEQ ID NO: 4621 - RNA, 21 nt, Homo sapiens
auuuagaaagcaguaccagua

SEQ ID NO: 4622 - RNA, 21 nt, Homo sapiens
uuuagaaagcaguaccaguaa

SEQ ID NO: 4623 - RNA, 21 nt, Homo sapiens
uuagaaagcaguaccaguaaa

SEQ ID NO: 4624 - RNA, 21 nt, Homo sapiens
uagaaagcaguaccaguaaac

SEQ ID NO: 4625 - RNA, 21 nt, Homo sapiens
agaaagcaguaccaguaaacg

SEQ ID NO: 4626 - RNA, 21 nt, Homo sapiens
gaaagcaguaccaguaaacgu

SEQ ID NO: 4627 - RNA, 21 nt, Homo sapiens
aaagcaguaccaguaaacguu

SEQ ID NO: 4628 - RNA, 21 nt, Homo sapiens
aagcaguaccaguaaacguua

SEQ ID NO: 4629 - RNA, 21 nt, Homo sapiens
agcaguaccaguaaacguuau

SEQ ID NO: 4630 - RNA, 21 nt, Homo sapiens
gcaguaccaguaaacguuauu

SEQ ID NO: 4631 - RNA, 21 nt, Homo sapiens
caguaccaguaaacguuauua

SEQ ID NO: 4632 - RNA, 21 nt, Homo sapiens
aguaccaguaaacguuauuac

SEQ ID NO: 4633 - RNA, 21 nt, Homo sapiens
guaccaguaaacguuauuaca

SEQ ID NO: 4634 - RNA, 21 nt, Homo sapiens
uaccaguaaacguuauuacaa

SEQ ID NO: 4635 - RNA, 21 nt, Homo sapiens
accaguaaacguuauuacaag

SEQ ID NO: 4636 - RNA, 21 nt, Homo sapiens
ccaguaaacguuauuacaagc

SEQ ID NO: 4637 - RNA, 21 nt, Homo sapiens
caguaaacguuauuacaagca

SEQ ID NO: 4638 - RNA, 21 nt, Homo sapiens
aguaaacguuauuacaagcau

SEQ ID NO: 4639 - RNA, 21 nt, Homo sapiens
guaaacguuauuacaagcauu

SEQ ID NO: 4640 - RNA, 21 nt, Homo sapiens
uaaacguuauuacaagcauua

SEQ ID NO: 4641 - RNA, 21 nt, Homo sapiens
aaacguuauuacaagcauuag

SEQ ID NO: 4642 - RNA, 21 nt, Homo sapiens
aacguuauuacaagcauuaga

SEQ ID NO: 4643 - RNA, 21 nt, Homo sapiens
acguuauuacaagcauuagau

SEQ ID NO: 4644 - RNA, 21 nt, Homo sapiens
cguuauuacaagcauuagaug

SEQ ID NO: 4645 - RNA, 21 nt, Homo sapiens
guuauuacaagcauuagaugu

SEQ ID NO: 4646 - RNA, 21 nt, Homo sapiens
uuauuacaagcauuagaugug

SEQ ID NO: 4647 - RNA, 21 nt, Homo sapiens
uauuacaagcauuagaugugu

SEQ ID NO: 4648 - RNA, 21 nt, Homo sapiens
auuacaagcauuagauguguu

SEQ ID NO: 4649 - RNA, 21 nt, Homo sapiens
uuacaagcauuagauguguuu

SEQ ID NO: 4650 - RNA, 21 nt, Homo sapiens
uacaagcauuagauguguuua

SEQ ID NO: 4651 - RNA, 21 nt, Homo sapiens
acaagcauuagauguguuuaa

SEQ ID NO: 4652 - RNA, 21 nt, Homo sapiens
caagcauuagauguguuuaaa

SEQ ID NO: 4653 - RNA, 21 nt, Homo sapiens
aagcauuagauguguuuaaaa

SEQ ID NO: 4654 - RNA, 21 nt, Homo sapiens
agcauuagauguguuuaaaaa

SEQ ID NO: 4655 - RNA, 21 nt, Homo sapiens
gcauuagauguguuuaaaaag

SEQ ID NO: 4656 - RNA, 21 nt, Homo sapiens
cauuagauguguuuaaaaagu

SEQ ID NO: 4657 - RNA, 21 nt, Homo sapiens
auuagauguguuuaaaaaguu

SEQ ID NO: 4658 - RNA, 21 nt, Homo sapiens
uuagauguguuuaaaaaguug

SEQ ID NO: 4659 - RNA, 21 nt, Homo sapiens
uagauguguuuaaaaaguuga

SEQ ID NO: 4660 - RNA, 21 nt, Homo sapiens
agauguguuuaaaaaguugau

SEQ ID NO: 4661 - RNA, 21 nt, Homo sapiens
gauguguuuaaaaaguugaua

SEQ ID NO: 4662 - RNA, 21 nt, Homo sapiens
auguguuuaaaaaguugauac

SEQ ID NO: 4663 - RNA, 21 nt, Homo sapiens
uguguuuaaaaaguugauacu

SEQ ID NO: 4664 - RNA, 21 nt, Homo sapiens
guguuuaaaaaguugauacua

SEQ ID NO: 4665 - RNA, 21 nt, Homo sapiens
uguuuaaaaaguugauacuaa

SEQ ID NO: 4666 - RNA, 21 nt, Homo sapiens
guuuaaaaaguugauacuaau

SEQ ID NO: 4667 - RNA, 21 nt, Homo sapiens
uuuaaaaaguugauacuaauu

SEQ ID NO: 4668 - RNA, 21 nt, Homo sapiens
uuaaaaaguugauacuaauuu

SEQ ID NO: 4669 - RNA, 21 nt, Homo sapiens
uaaaaaguugauacuaauuua

SEQ ID NO: 4670 - RNA, 21 nt, Homo sapiens
aaaaaguugauacuaauuuau

SEQ ID NO: 4671 - RNA, 21 nt, Homo sapiens
aaaaguugauacuaauuuaua

SEQ ID NO: 4672 - RNA, 21 nt, Homo sapiens
aaaguugauacuaauuuauaa

SEQ ID NO: 4673 - RNA, 21 nt, Homo sapiens
aaguugauacuaauuuauaac

SEQ ID NO: 4674 - RNA, 21 nt, Homo sapiens
aguugauacuaauuuauaacc

SEQ ID NO: 4675 - RNA, 21 nt, Homo sapiens
guugauacuaauuuauaaccu

SEQ ID NO: 4676 - RNA, 21 nt, Homo sapiens
uugauacuaauuuauaaccug

SEQ ID NO: 4677 - RNA, 21 nt, Homo sapiens
ugauacuaauuuauaaccugu

SEQ ID NO: 4678 - RNA, 21 nt, Homo sapiens
gauacuaauuuauaaccugua

SEQ ID NO: 4679 - RNA, 21 nt, Homo sapiens
auacuaauuuauaaccuguaa

SEQ ID NO: 4680 - RNA, 21 nt, Homo sapiens
uacuaauuuauaaccuguaau

SEQ ID NO: 4681 - RNA, 21 nt, Homo sapiens
acuaauuuauaaccuguaauu

SEQ ID NO: 4682 - RNA, 21 nt, Homo sapiens
cuaauuuauaaccuguaauug

SEQ ID NO: 4683 - RNA, 21 nt, Homo sapiens
uaauuuauaaccuguaauugu

SEQ ID NO: 4684 - RNA, 21 nt, Homo sapiens
aauuuauaaccuguaauuguu

SEQ ID NO: 4685 - RNA, 21 nt, Homo sapiens
auuuauaaccuguaauuguua

SEQ ID NO: 4686 - RNA, 21 nt, Homo sapiens
uuuauaaccuguaauuguuaa

SEQ ID NO: 4687 - RNA, 21 nt, Homo sapiens
uuauaaccuguaauuguuaaa

SEQ ID NO: 4688 - RNA, 21 nt, Homo sapiens
uauaaccuguaauuguuaaau

SEQ ID NO: 4689 - RNA, 21 nt, Homo sapiens
auaaccuguaauuguuaaaug

SEQ ID NO: 4690 - RNA, 21 nt, Homo sapiens
uaaccuguaauuguuaaaugu

SEQ ID NO: 4691 - RNA, 21 nt, Homo sapiens
aaccuguaauuguuaaaugug

SEQ ID NO: 4692 - RNA, 21 nt, Homo sapiens
accuguaauuguuaaaugugc

SEQ ID NO: 4693 - RNA, 21 nt, Homo sapiens
ccuguaauuguuaaaugugca

SEQ ID NO: 4694 - RNA, 21 nt, Homo sapiens
cuguaauuguuaaaugugcau

SEQ ID NO: 4695 - RNA, 21 nt, Homo sapiens
uguaauuguuaaaugugcaug

SEQ ID NO: 4696 - RNA, 21 nt, Homo sapiens
guaauuguuaaaugugcauga

SEQ ID NO: 4697 - RNA, 21 nt, Homo sapiens
uaauuguuaaaugugcaugac

SEQ ID NO: 4698 - RNA, 21 nt, Homo sapiens
aauuguuaaaugugcaugacu

SEQ ID NO: 4699 - RNA, 21 nt, Homo sapiens
auuguuaaaugugcaugacuu

SEQ ID NO: 4700 - RNA, 21 nt, Homo sapiens
uuguuaaaugugcaugacuua

SEQ ID NO: 4701 - RNA, 21 nt, Homo sapiens
uguuaaaugugcaugacuuaa

SEQ ID NO: 4702 - RNA, 21 nt, Homo sapiens
guuaaaugugcaugacuuaaa

SEQ ID NO: 4703 - RNA, 21 nt, Homo sapiens
uuaaaugugcaugacuuaaau

SEQ ID NO: 4704 - RNA, 21 nt, Homo sapiens
uaaaugugcaugacuuaaaug

SEQ ID NO: 4705 - RNA, 21 nt, Homo sapiens
aaaugugcaugacuuaaaugu

SEQ ID NO: 4706 - RNA, 21 nt, Homo sapiens
aaugugcaugacuuaaauguu

SEQ ID NO: 4707 - RNA, 21 nt, Homo sapiens
augugcaugacuuaaauguua

SEQ ID NO: 4708 - RNA, 21 nt, Homo sapiens
ugugcaugacuuaaauguuaa

SEQ ID NO: 4709 - RNA, 21 nt, Homo sapiens
gugcaugacuuaaauguuaaa

SEQ ID NO: 4710 - RNA, 21 nt, Homo sapiens
ugcaugacuuaaauguuaaaa

SEQ ID NO: 4711 - RNA, 21 nt, Homo sapiens
gcaugacuuaaauguuaaaau

SEQ ID NO: 4712 - RNA, 21 nt, Homo sapiens
caugacuuaaauguuaaaauc

SEQ ID NO: 4713 - RNA, 21 nt, Homo sapiens
augacuuaaauguuaaaaucc

SEQ ID NO: 4714 - RNA, 21 nt, Homo sapiens
ugacuuaaauguuaaaauccu

SEQ ID NO: 4715 - RNA, 21 nt, Homo sapiens
gacuuaaauguuaaaauccug

SEQ ID NO: 4716 - RNA, 21 nt, Homo sapiens
acuuaaauguuaaaauccugu

SEQ ID NO: 4717 - RNA, 21 nt, Homo sapiens
cuuaaauguuaaaauccugua

SEQ ID NO: 4718 - RNA, 21 nt, Homo sapiens
uuaaauguuaaaauccuguau

SEQ ID NO: 4719 - RNA, 21 nt, Homo sapiens
uaaauguuaaaauccuguauu

SEQ ID NO: 4720 - RNA, 21 nt, Homo sapiens
aaauguuaaaauccuguauuu

SEQ ID NO: 4721 - RNA, 21 nt, Homo sapiens
aauguuaaaauccuguauuuu

SEQ ID NO: 4722 - RNA, 21 nt, Homo sapiens
auguuaaaauccuguauuuua

SEQ ID NO: 4723 - RNA, 21 nt, Homo sapiens
uguuaaaauccuguauuuuaa

SEQ ID NO: 4724 - RNA, 21 nt, Homo sapiens
guuaaaauccuguauuuuaag

SEQ ID NO: 4725 - RNA, 21 nt, Homo sapiens
uuaaaauccuguauuuuaaga

SEQ ID NO: 4726 - RNA, 21 nt, Homo sapiens
uaaaauccuguauuuuaagau

SEQ ID NO: 4727 - RNA, 21 nt, Homo sapiens
aaaauccuguauuuuaagaua

SEQ ID NO: 4728 - RNA, 21 nt, Homo sapiens
aaauccuguauuuuaagauag

SEQ ID NO: 4729 - RNA, 21 nt, Homo sapiens
aauccuguauuuuaagauagu

SEQ ID NO: 4730 - RNA, 21 nt, Homo sapiens
auccuguauuuuaagauaguc

SEQ ID NO: 4731 - RNA, 21 nt, Homo sapiens
uccuguauuuuaagauagucu

SEQ ID NO: 4732 - RNA, 21 nt, Homo sapiens
ccuguauuuuaagauagucuu

SEQ ID NO: 4733 - RNA, 21 nt, Homo sapiens
cuguauuuuaagauagucuuc

SEQ ID NO: 4734 - RNA, 21 nt, Homo sapiens
uguauuuuaagauagucuucu

SEQ ID NO: 4735 - RNA, 21 nt, Homo sapiens
guauuuuaagauagucuucug

SEQ ID NO: 4736 - RNA, 21 nt, Homo sapiens
uauuuuaagauagucuucugc

SEQ ID NO: 4737 - RNA, 21 nt, Homo sapiens
auuuuaagauagucuucugca

SEQ ID NO: 4738 - RNA, 21 nt, Homo sapiens
uuuuaagauagucuucugcag

SEQ ID NO: 4739 - RNA, 21 nt, Homo sapiens
uuuaagauagucuucugcagu

SEQ ID NO: 4740 - RNA, 21 nt, Homo sapiens
uuaagauagucuucugcaguu

SEQ ID NO: 4741 - RNA, 21 nt, Homo sapiens
uaagauagucuucugcaguua

SEQ ID NO: 4742 - RNA, 21 nt, Homo sapiens
aagauagucuucugcaguuac

SEQ ID NO: 4743 - RNA, 21 nt, Homo sapiens
agauagucuucugcaguuaca

SEQ ID NO: 4744 - RNA, 21 nt, Homo sapiens
gauagucuucugcaguuacaa

SEQ ID NO: 4745 - RNA, 21 nt, Homo sapiens
auagucuucugcaguuacaaa

SEQ ID NO: 4746 - RNA, 21 nt, Homo sapiens
uagucuucugcaguuacaaau

SEQ ID NO: 4747 - RNA, 21 nt, Homo sapiens
agucuucugcaguuacaaauc

SEQ ID NO: 4748 - RNA, 21 nt, Homo sapiens
gucuucugcaguuacaaaucc

SEQ ID NO: 4749 - RNA, 21 nt, Homo sapiens
ucuucugcaguuacaaaucca

SEQ ID NO: 4750 - RNA, 21 nt, Homo sapiens
cuucugcaguuacaaauccau

SEQ ID NO: 4751 - RNA, 21 nt, Homo sapiens
uucugcaguuacaaauccaua

SEQ ID NO: 4752 - RNA, 21 nt, Homo sapiens
ucugcaguuacaaauccauau

SEQ ID NO: 4753 - RNA, 21 nt, Homo sapiens
cugcaguuacaaauccauaua

SEQ ID NO: 4754 - RNA, 21 nt, Homo sapiens
ugcaguuacaaauccauauac

SEQ ID NO: 4755 - RNA, 21 nt, Homo sapiens
gcaguuacaaauccauauacc

SEQ ID NO: 4756 - RNA, 21 nt, Homo sapiens
caguuacaaauccauauaccc

SEQ ID NO: 4757 - RNA, 21 nt, Homo sapiens
aguuacaaauccauauaccca

SEQ ID NO: 4758 - RNA, 21 nt, Homo sapiens
guuacaaauccauauacccag

SEQ ID NO: 4759 - RNA, 21 nt, Homo sapiens
uuacaaauccauauacccaga

SEQ ID NO: 4760 - RNA, 21 nt, Homo sapiens
uacaaauccauauacccagau

SEQ ID NO: 4761 - RNA, 21 nt, Homo sapiens
acaaauccauauacccagauu

SEQ ID NO: 4762 - RNA, 21 nt, Homo sapiens
caaauccauauacccagauuu

SEQ ID NO: 4763 - RNA, 21 nt, Homo sapiens
aaauccauauacccagauuuc

SEQ ID NO: 4764 - RNA, 21 nt, Homo sapiens
aauccauauacccagauuucc

SEQ ID NO: 4765 - RNA, 21 nt, Homo sapiens
auccauauacccagauuuccu

SEQ ID NO: 4766 - RNA, 21 nt, Homo sapiens
uccauauacccagauuuccug

SEQ ID NO: 4767 - RNA, 21 nt, Homo sapiens
ccauauacccagauuuccugu

SEQ ID NO: 4768 - RNA, 21 nt, Homo sapiens
cauauacccagauuuccugua

SEQ ID NO: 4769 - RNA, 21 nt, Homo sapiens
auauacccagauuuccuguag

SEQ ID NO: 4770 - RNA, 21 nt, Homo sapiens
uauacccagauuuccuguagg

SEQ ID NO: 4771 - RNA, 21 nt, Homo sapiens
auacccagauuuccuguaggc

SEQ ID NO: 4772 - RNA, 21 nt, Homo sapiens
uacccagauuuccuguaggcu

SEQ ID NO: 4773 - RNA, 21 nt, Homo sapiens
acccagauuuccuguaggcuu

SEQ ID NO: 4774 - RNA, 21 nt, Homo sapiens
cccagauuuccuguaggcuuc

SEQ ID NO: 4775 - RNA, 21 nt, Homo sapiens
ccagauuuccuguaggcuuca

SEQ ID NO: 4776 - RNA, 21 nt, Homo sapiens
cagauuuccuguaggcuucac

SEQ ID NO: 4777 - RNA, 21 nt, Homo sapiens
agauuuccuguaggcuucaca

SEQ ID NO: 4778 - RNA, 21 nt, Homo sapiens
gauuuccuguaggcuucacaa

SEQ ID NO: 4779 - RNA, 21 nt, Homo sapiens
auuuccuguaggcuucacaaa

SEQ ID NO: 4780 - RNA, 21 nt, Homo sapiens
uuuccuguaggcuucacaaau

SEQ ID NO: 4781 - RNA, 21 nt, Homo sapiens
uuccuguaggcuucacaaauc

SEQ ID NO: 4782 - RNA, 21 nt, Homo sapiens
uccuguaggcuucacaaaucg

SEQ ID NO: 4783 - RNA, 21 nt, Homo sapiens
ccuguaggcuucacaaaucgg

SEQ ID NO: 4784 - RNA, 21 nt, Homo sapiens
cuguaggcuucacaaaucgga

SEQ ID NO: 4785 - RNA, 21 nt, Homo sapiens
uguaggcuucacaaaucggag

SEQ ID NO: 4786 - RNA, 21 nt, Homo sapiens
guaggcuucacaaaucggagg

SEQ ID NO: 4787 - RNA, 21 nt, Homo sapiens
uaggcuucacaaaucggaggg

SEQ ID NO: 4788 - RNA, 21 nt, Homo sapiens
aggcuucacaaaucggagggg

SEQ ID NO: 4789 - RNA, 21 nt, Homo sapiens
ggcuucacaaaucggaggggu

SEQ ID NO: 4790 - RNA, 21 nt, Homo sapiens
gcuucacaaaucggaggggua

SEQ ID NO: 4791 - RNA, 21 nt, Homo sapiens
cuucacaaaucggagggguac

SEQ ID NO: 4792 - RNA, 21 nt, Homo sapiens
uucacaaaucggagggguaca

SEQ ID NO: 4793 - RNA, 21 nt, Homo sapiens
ucacaaaucggagggguacau

SEQ ID NO: 4794 - RNA, 21 nt, Homo sapiens
cacaaaucggagggguacaua

SEQ ID NO: 4795 - RNA, 21 nt, Homo sapiens
acaaaucggagggguacauag

SEQ ID NO: 4796 - RNA, 21 nt, Homo sapiens
caaaucggagggguacauaga

SEQ ID NO: 4797 - RNA, 21 nt, Homo sapiens
aaaucggagggguacauagaa

SEQ ID NO: 4798 - RNA, 21 nt, Homo sapiens
aaucggagggguacauagaau

SEQ ID NO: 4799 - RNA, 21 nt, Homo sapiens
aucggagggguacauagaaug

SEQ ID NO: 4800 - RNA, 21 nt, Homo sapiens
ucggagggguacauagaaugu

SEQ ID NO: 4801 - RNA, 21 nt, Homo sapiens
cggagggguacauagaaugug

SEQ ID NO: 4802 - RNA, 21 nt, Homo sapiens
ggagggguacauagaaugugc

SEQ ID NO: 4803 - RNA, 21 nt, Homo sapiens
gagggguacauagaaugugca

SEQ ID NO: 4804 - RNA, 21 nt, Homo sapiens
agggguacauagaaugugcaa

SEQ ID NO: 4805 - RNA, 21 nt, Homo sapiens
gggguacauagaaugugcaag

SEQ ID NO: 4806 - RNA, 21 nt, Homo sapiens
ggguacauagaaugugcaaga

SEQ ID NO: 4807 - RNA, 21 nt, Homo sapiens
gguacauagaaugugcaagag

SEQ ID NO: 4808 - RNA, 21 nt, Homo sapiens
guacauagaaugugcaagagu

SEQ ID NO: 4809 - RNA, 21 nt, Homo sapiens
uacauagaaugugcaagaguc

SEQ ID NO: 4810 - RNA, 21 nt, Homo sapiens
acauagaaugugcaagaguca

SEQ ID NO: 4811 - RNA, 21 nt, Homo sapiens
cauagaaugugcaagagucaa

SEQ ID NO: 4812 - RNA, 21 nt, Homo sapiens
auagaaugugcaagagucaaa

SEQ ID NO: 4813 - RNA, 21 nt, Homo sapiens
uagaaugugcaagagucaaag

SEQ ID NO: 4814 - RNA, 21 nt, Homo sapiens
agaaugugcaagagucaaagg

SEQ ID NO: 4815 - RNA, 21 nt, Homo sapiens
gaaugugcaagagucaaagga

SEQ ID NO: 4816 - RNA, 21 nt, Homo sapiens
aaugugcaagagucaaaggau

SEQ ID NO: 4817 - RNA, 21 nt, Homo sapiens
augugcaagagucaaaggaua

SEQ ID NO: 4818 - RNA, 21 nt, Homo sapiens
ugugcaagagucaaaggauaa

SEQ ID NO: 4819 - RNA, 21 nt, Homo sapiens
gugcaagagucaaaggauaaa

SEQ ID NO: 4820 - RNA, 21 nt, Homo sapiens
ugcaagagucaaaggauaaau

SEQ ID NO: 4821 - RNA, 21 nt, Homo sapiens
gcaagagucaaaggauaaaua

SEQ ID NO: 4822 - RNA, 21 nt, Homo sapiens
caagagucaaaggauaaauaa

SEQ ID NO: 4823 - RNA, 21 nt, Homo sapiens
aagagucaaaggauaaauaau

SEQ ID NO: 4824 - RNA, 21 nt, Homo sapiens
agagucaaaggauaaauaaua

SEQ ID NO: 4825 - RNA, 21 nt, Homo sapiens
gagucaaaggauaaauaauau

SEQ ID NO: 4826 - RNA, 21 nt, Homo sapiens
agucaaaggauaaauaauauu

SEQ ID NO: 4827 - RNA, 21 nt, Homo sapiens
gucaaaggauaaauaauauua

SEQ ID NO: 4828 - RNA, 21 nt, Homo sapiens
ucaaaggauaaauaauauuau

SEQ ID NO: 4829 - RNA, 21 nt, Homo sapiens
caaaggauaaauaauauuaua

SEQ ID NO: 4830 - RNA, 21 nt, Homo sapiens
aaaggauaaauaauauuauaa

SEQ ID NO: 4831 - RNA, 21 nt, Homo sapiens
aaggauaaauaauauuauaaa

SEQ ID NO: 4832 - RNA, 21 nt, Homo sapiens
aggauaaauaauauuauaaau

SEQ ID NO: 4833 - RNA, 21 nt, Homo sapiens
ggauaaauaauauuauaaaua

SEQ ID NO: 4834 - RNA, 21 nt, Homo sapiens
gauaaauaauauuauaaauau

SEQ ID NO: 4835 - RNA, 21 nt, Homo sapiens
auaaauaauauuauaaauaua

SEQ ID NO: 4836 - RNA, 21 nt, Homo sapiens
uaaauaauauuauaaauauau

SEQ ID NO: 4837 - RNA, 21 nt, Homo sapiens
aaauaauauuauaaauauaua

SEQ ID NO: 4838 - RNA, 21 nt, Homo sapiens
aauaauauuauaaauauauau

SEQ ID NO: 4839 - RNA, 21 nt, Homo sapiens
auaauauuauaaauauauauu

SEQ ID NO: 4840 - RNA, 21 nt, Homo sapiens
uaauauuauaaauauauauua

SEQ ID NO: 4841 - RNA, 21 nt, Homo sapiens
aauauuauaaauauauauuaa

SEQ ID NO: 4842 - RNA, 21 nt, Homo sapiens
auauuauaaauauauauuaac

SEQ ID NO: 4843 - RNA, 21 nt, Homo sapiens
uauuauaaauauauauuaacu

SEQ ID NO: 4844 - RNA, 21 nt, Homo sapiens
auuauaaauauauauuaacua

SEQ ID NO: 4845 - RNA, 21 nt, Homo sapiens
uuauaaauauauauuaacuau

SEQ ID NO: 4846 - RNA, 21 nt, Homo sapiens
uauaaauauauauuaacuaua

SEQ ID NO: 4847 - RNA, 21 nt, Homo sapiens
auaaauauauauuaacuauau

SEQ ID NO: 4848 - RNA, 21 nt, Homo sapiens
uaaauauauauuaacuauauu

SEQ ID NO: 4849 - RNA, 21 nt, Homo sapiens
aaauauauauuaacuauauua

SEQ ID NO: 4850 - RNA, 21 nt, Homo sapiens
aauauauauuaacuauauuac

SEQ ID NO: 4851 - RNA, 21 nt, Homo sapiens
auauauauuaacuauauuacc

SEQ ID NO: 4852 - RNA, 21 nt, Homo sapiens
uauauauuaacuauauuaccu

SEQ ID NO: 4853 - RNA, 21 nt, Homo sapiens
auauauuaacuauauuaccua

SEQ ID NO: 4854 - RNA, 21 nt, Homo sapiens
uauauuaacuauauuaccuaa

SEQ ID NO: 4855 - RNA, 21 nt, Homo sapiens
auauuaacuauauuaccuaau

SEQ ID NO: 4856 - RNA, 21 nt, Homo sapiens
uauuaacuauauuaccuaauu

SEQ ID NO: 4857 - RNA, 21 nt, Homo sapiens
auuaacuauauuaccuaauua

SEQ ID NO: 4858 - RNA, 21 nt, Homo sapiens
uuaacuauauuaccuaauuaa

SEQ ID NO: 4859 - RNA, 21 nt, Homo sapiens
uaacuauauuaccuaauuaaa

SEQ ID NO: 4860 - RNA, 21 nt, Homo sapiens
aacuauauuaccuaauuaaaa

SEQ ID NO: 4861 - RNA, 21 nt, Homo sapiens
acuauauuaccuaauuaaaac

SEQ ID NO: 4862 - RNA, 21 nt, Homo sapiens
cuauauuaccuaauuaaaacc

SEQ ID NO: 4863 - RNA, 21 nt, Homo sapiens
uauauuaccuaauuaaaacca

SEQ ID NO: 4864 - RNA, 21 nt, Homo sapiens
auauuaccuaauuaaaaccau

SEQ ID NO: 4865 - RNA, 21 nt, Homo sapiens
uauuaccuaauuaaaaccaua

SEQ ID NO: 4866 - RNA, 21 nt, Homo sapiens
auuaccuaauuaaaaccauaa

SEQ ID NO: 4867 - RNA, 21 nt, Homo sapiens
uuaccuaauuaaaaccauaau

SEQ ID NO: 4868 - RNA, 21 nt, Homo sapiens
uaccuaauuaaaaccauaauc

SEQ ID NO: 4869 - RNA, 21 nt, Homo sapiens
accuaauuaaaaccauaaucu

SEQ ID NO: 4870 - RNA, 21 nt, Homo sapiens
ccuaauuaaaaccauaaucug

SEQ ID NO: 4871 - RNA, 21 nt, Homo sapiens
cuaauuaaaaccauaaucugu

SEQ ID NO: 4872 - RNA, 21 nt, Homo sapiens
uaauuaaaaccauaaucuguu

SEQ ID NO: 4873 - RNA, 21 nt, Homo sapiens
aauuaaaaccauaaucuguua

SEQ ID NO: 4874 - RNA, 21 nt, Homo sapiens
auuaaaaccauaaucuguuaa

SEQ ID NO: 4875 - RNA, 21 nt, Homo sapiens
uuaaaaccauaaucuguuaau

SEQ ID NO: 4876 - RNA, 21 nt, Homo sapiens
uaaaaccauaaucuguuaaua

SEQ ID NO: 4877 - RNA, 21 nt, Homo sapiens
aaaaccauaaucuguuaauac

SEQ ID NO: 4878 - RNA, 21 nt, Homo sapiens
aaaccauaaucuguuaauaca

SEQ ID NO: 4879 - RNA, 21 nt, Homo sapiens
aaccauaaucuguuaauacag

SEQ ID NO: 4880 - RNA, 21 nt, Homo sapiens
accauaaucuguuaauacagc

SEQ ID NO: 4881 - RNA, 21 nt, Homo sapiens
ccauaaucuguuaauacagcu

SEQ ID NO: 4882 - RNA, 21 nt, Homo sapiens
cauaaucuguuaauacagcua

SEQ ID NO: 4883 - RNA, 21 nt, Homo sapiens
auaaucuguuaauacagcuau

SEQ ID NO: 4884 - RNA, 21 nt, Homo sapiens
uaaucuguuaauacagcuaug

SEQ ID NO: 4885 - RNA, 21 nt, Homo sapiens
aaucuguuaauacagcuaugg

SEQ ID NO: 4886 - RNA, 21 nt, Homo sapiens
aucuguuaauacagcuaugga

SEQ ID NO: 4887 - RNA, 21 nt, Homo sapiens
ucuguuaauacagcuauggau

SEQ ID NO: 4888 - RNA, 21 nt, Homo sapiens
cuguuaauacagcuauggauu

SEQ ID NO: 4889 - RNA, 21 nt, Homo sapiens
uguuaauacagcuauggauua

SEQ ID NO: 4890 - RNA, 21 nt, Homo sapiens
guuaauacagcuauggauuaa

SEQ ID NO: 4891 - RNA, 21 nt, Homo sapiens
uuaauacagcuauggauuaau

SEQ ID NO: 4892 - RNA, 21 nt, Homo sapiens
uaauacagcuauggauuaauu

SEQ ID NO: 4893 - RNA, 21 nt, Homo sapiens
aauacagcuauggauuaauuu

SEQ ID NO: 4894 - RNA, 21 nt, Homo sapiens
auacagcuauggauuaauuuc

SEQ ID NO: 4895 - RNA, 21 nt, Homo sapiens
uacagcuauggauuaauuuca

SEQ ID NO: 4896 - RNA, 21 nt, Homo sapiens
acagcuauggauuaauuucaa

SEQ ID NO: 4897 - RNA, 21 nt, Homo sapiens
cagcuauggauuaauuucaaa

SEQ ID NO: 4898 - RNA, 21 nt, Homo sapiens
agcuauggauuaauuucaaaa

SEQ ID NO: 4899 - RNA, 21 nt, Homo sapiens
gcuauggauuaauuucaaaaa

SEQ ID NO: 4900 - RNA, 21 nt, Homo sapiens
cuauggauuaauuucaaaaaa

SEQ ID NO: 4901 - RNA, 21 nt, Homo sapiens
uauggauuaauuucaaaaaaa

SEQ ID NO: 4902 - RNA, 21 nt, Homo sapiens
auggauuaauuucaaaaaaau

SEQ ID NO: 4903 - RNA, 21 nt, Homo sapiens
uggauuaauuucaaaaaaaug

SEQ ID NO: 4904 - RNA, 21 nt, Homo sapiens
ggauuaauuucaaaaaaaugu

SEQ ID NO: 4905 - RNA, 21 nt, Homo sapiens
gauuaauuucaaaaaaaugua

SEQ ID NO: 4906 - RNA, 21 nt, Homo sapiens
auuaauuucaaaaaaauguaa

SEQ ID NO: 4907 - RNA, 21 nt, Homo sapiens
uuaauuucaaaaaaauguaau

SEQ ID NO: 4908 - RNA, 21 nt, Homo sapiens
uaauuucaaaaaaauguaauc

SEQ ID NO: 4909 - RNA, 21 nt, Homo sapiens
aauuucaaaaaaauguaauca

SEQ ID NO: 4910 - RNA, 21 nt, Homo sapiens
auuucaaaaaaauguaaucaa

SEQ ID NO: 4911 - RNA, 21 nt, Homo sapiens
uuucaaaaaaauguaaucaaa

SEQ ID NO: 4912 - RNA, 21 nt, Homo sapiens
uucaaaaaaauguaaucaaau

SEQ ID NO: 4913 - RNA, 21 nt, Homo sapiens
ucaaaaaaauguaaucaaaua

SEQ ID NO: 4914 - RNA, 21 nt, Homo sapiens
caaaaaaauguaaucaaauau

SEQ ID NO: 4915 - RNA, 21 nt, Homo sapiens
aaaaaaauguaaucaaauaua

SEQ ID NO: 4916 - RNA, 21 nt, Homo sapiens
aaaaaauguaaucaaauauau

SEQ ID NO: 4917 - RNA, 21 nt, Homo sapiens
aaaaauguaaucaaauauauu

SEQ ID NO: 4918 - RNA, 21 nt, Homo sapiens
aaaauguaaucaaauauauua

SEQ ID NO: 4919 - RNA, 21 nt, Homo sapiens
aaauguaaucaaauauauuac

SEQ ID NO: 4920 - RNA, 21 nt, Homo sapiens
aauguaaucaaauauauuacu

SEQ ID NO: 4921 - RNA, 21 nt, Homo sapiens
auguaaucaaauauauuacua

SEQ ID NO: 4922 - RNA, 21 nt, Homo sapiens
uguaaucaaauauauuacuaa

SEQ ID NO: 4923 - RNA, 21 nt, Homo sapiens
guaaucaaauauauuacuaau

SEQ ID NO: 4924 - RNA, 21 nt, Homo sapiens
uaaucaaauauauuacuaaug

SEQ ID NO: 4925 - RNA, 21 nt, Homo sapiens
aaucaaauauauuacuaaugg

SEQ ID NO: 4926 - RNA, 21 nt, Homo sapiens
aucaaauauauuacuaauggu

SEQ ID NO: 4927 - RNA, 21 nt, Homo sapiens
ucaaauauauuacuaauggug

SEQ ID NO: 4928 - RNA, 21 nt, Homo sapiens
caaauauauuacuaauggugu

SEQ ID NO: 4929 - RNA, 21 nt, Homo sapiens
aaauauauuacuaauggugua

SEQ ID NO: 4930 - RNA, 21 nt, Homo sapiens
aauauauuacuaaugguguag

SEQ ID NO: 4931 - RNA, 21 nt, Homo sapiens
auauauuacuaaugguguagu

SEQ ID NO: 4932 - RNA, 21 nt, Homo sapiens
uauauuacuaaugguguaguu

SEQ ID NO: 4933 - RNA, 21 nt, Homo sapiens
auauuacuaaugguguaguug

SEQ ID NO: 4934 - RNA, 21 nt, Homo sapiens
uauuacuaaugguguaguugg

SEQ ID NO: 4935 - RNA, 21 nt, Homo sapiens
auuacuaaugguguaguuggc

SEQ ID NO: 4936 - RNA, 21 nt, Homo sapiens
uuacuaaugguguaguuggcu

SEQ ID NO: 4937 - RNA, 21 nt, Homo sapiens
uacuaaugguguaguuggcug

SEQ ID NO: 4938 - RNA, 21 nt, Homo sapiens
acuaaugguguaguuggcugu

SEQ ID NO: 4939 - RNA, 21 nt, Homo sapiens
cuaaugguguaguuggcuguu

SEQ ID NO: 4940 - RNA, 21 nt, Homo sapiens
uaaugguguaguuggcuguuu

SEQ ID NO: 4941 - RNA, 21 nt, Homo sapiens
aaugguguaguuggcuguuuu

SEQ ID NO: 4942 - RNA, 21 nt, Homo sapiens
augguguaguuggcuguuuuc

SEQ ID NO: 4943 - RNA, 21 nt, Homo sapiens
ugguguaguuggcuguuuucc

SEQ ID NO: 4944 - RNA, 21 nt, Homo sapiens
gguguaguuggcuguuuucca

SEQ ID NO: 4945 - RNA, 21 nt, Homo sapiens
guguaguuggcuguuuuccaa

SEQ ID NO: 4946 - RNA, 21 nt, Homo sapiens
uguaguuggcuguuuuccaau

SEQ ID NO: 4947 - RNA, 21 nt, Homo sapiens
guaguuggcuguuuuccaaug

SEQ ID NO: 4948 - RNA, 21 nt, Homo sapiens
uaguuggcuguuuuccaaugu

SEQ ID NO: 4949 - RNA, 21 nt, Homo sapiens
aguuggcuguuuuccaauguu

SEQ ID NO: 4950 - RNA, 21 nt, Homo sapiens
guuggcuguuuuccaauguug

SEQ ID NO: 4951 - RNA, 21 nt, Homo sapiens
uuggcuguuuuccaauguugg

SEQ ID NO: 4952 - RNA, 21 nt, Homo sapiens
uggcuguuuuccaauguuggu

SEQ ID NO: 4953 - RNA, 21 nt, Homo sapiens
ggcuguuuuccaauguuggua

SEQ ID NO: 4954 - RNA, 21 nt, Homo sapiens
gcuguuuuccaauguugguaa

SEQ ID NO: 4955 - RNA, 21 nt, Homo sapiens
cuguuuuccaauguugguaaa

SEQ ID NO: 4956 - RNA, 21 nt, Homo sapiens
uguuuuccaauguugguaaag

SEQ ID NO: 4957 - RNA, 21 nt, Homo sapiens
guuuuccaauguugguaaagu

SEQ ID NO: 4958 - RNA, 21 nt, Homo sapiens
uuuuccaauguugguaaaguu

SEQ ID NO: 4959 - RNA, 21 nt, Homo sapiens
uuuccaauguugguaaaguua

SEQ ID NO: 4960 - RNA, 21 nt, Homo sapiens
uuccaauguugguaaaguuau

SEQ ID NO: 4961 - RNA, 21 nt, Homo sapiens
uccaauguugguaaaguuauu

SEQ ID NO: 4962 - RNA, 21 nt, Homo sapiens
ccaauguugguaaaguuauua

SEQ ID NO: 4963 - RNA, 21 nt, Homo sapiens
caauguugguaaaguuauuaa

SEQ ID NO: 4964 - RNA, 21 nt, Homo sapiens
aauguugguaaaguuauuaaa

SEQ ID NO: 4965 - RNA, 21 nt, Homo sapiens
auguugguaaaguuauuaaag

SEQ ID NO: 4966 - RNA, 21 nt, Homo sapiens
uguugguaaaguuauuaaagu

SEQ ID NO: 4967 - RNA, 21 nt, Homo sapiens
guugguaaaguuauuaaaguu

SEQ ID NO: 4968 - RNA, 21 nt, Homo sapiens
uugguaaaguuauuaaaguuc

SEQ ID NO: 4969 - RNA, 21 nt, Homo sapiens
ugguaaaguuauuaaaguucu

SEQ ID NO: 4970 - RNA, 21 nt, Homo sapiens
gguaaaguuauuaaaguucuu

SEQ ID NO: 4971 - RNA, 21 nt, Homo sapiens
guaaaguuauuaaaguucuuc

SEQ ID NO: 4972 - RNA, 21 nt, Homo sapiens
uaaaguuauuaaaguucuuca

SEQ ID NO: 4973 - RNA, 21 nt, Homo sapiens
aaaguuauuaaaguucuucac

SEQ ID NO: 4974 - RNA, 21 nt, Homo sapiens
aaguuauuaaaguucuucacu

SEQ ID NO: 4975 - RNA, 21 nt, Homo sapiens
aguuauuaaaguucuucacuu

SEQ ID NO: 4976 - RNA, 21 nt, Homo sapiens
guuauuaaaguucuucacuuu

SEQ ID NO: 4977 - RNA, 21 nt, Homo sapiens
uuauuaaaguucuucacuuuc

SEQ ID NO: 4978 - RNA, 21 nt, Homo sapiens
uauuaaaguucuucacuuuca

SEQ ID NO: 4979 - RNA, 21 nt, Homo sapiens
auuaaaguucuucacuuucau

SEQ ID NO: 4980 - RNA, 21 nt, Homo sapiens
uuaaaguucuucacuuucaua

SEQ ID NO: 4981 - RNA, 21 nt, Homo sapiens
uaaaguucuucacuuucauag

SEQ ID NO: 4982 - RNA, 21 nt, Homo sapiens
aaaguucuucacuuucauaga

SEQ ID NO: 4983 - RNA, 21 nt, Homo sapiens
aaguucuucacuuucauagag

SEQ ID NO: 4984 - RNA, 21 nt, Homo sapiens
aguucuucacuuucauagagu

SEQ ID NO: 4985 - RNA, 21 nt, Homo sapiens
guucuucacuuucauagaguc

SEQ ID NO: 4986 - RNA, 21 nt, Homo sapiens
uucuucacuuucauagagucc

SEQ ID NO: 4987 - RNA, 21 nt, Homo sapiens
ucuucacuuucauagagucca

SEQ ID NO: 4988 - RNA, 21 nt, Homo sapiens
cuucacuuucauagaguccag

SEQ ID NO: 4989 - RNA, 21 nt, Homo sapiens
uucacuuucauagaguccaga

SEQ ID NO: 4990 - RNA, 21 nt, Homo sapiens
ucacuuucauagaguccagau

SEQ ID NO: 4991 - RNA, 21 nt, Homo sapiens
cacuuucauagaguccagauu

SEQ ID NO: 4992 - RNA, 21 nt, Homo sapiens
acuuucauagaguccagauug

SEQ ID NO: 4993 - RNA, 21 nt, Homo sapiens
cuuucauagaguccagauuga

SEQ ID NO: 4994 - RNA, 21 nt, Homo sapiens
uuucauagaguccagauugag

SEQ ID NO: 4995 - RNA, 21 nt, Homo sapiens
uucauagaguccagauugagc

SEQ ID NO: 4996 - RNA, 21 nt, Homo sapiens
ucauagaguccagauugagcu

SEQ ID NO: 4997 - RNA, 21 nt, Homo sapiens
cauagaguccagauugagcug

SEQ ID NO: 4998 - RNA, 21 nt, Homo sapiens
auagaguccagauugagcugc

SEQ ID NO: 4999 - RNA, 21 nt, Homo sapiens
uagaguccagauugagcugcc

SEQ ID NO: 5000 - RNA, 21 nt, Homo sapiens
agaguccagauugagcugcca

SEQ ID NO: 5001 - RNA, 21 nt, Homo sapiens
gaguccagauugagcugccaa

SEQ ID NO: 5002 - RNA, 21 nt, Homo sapiens
aguccagauugagcugccaaa

SEQ ID NO: 5003 - RNA, 21 nt, Homo sapiens
guccagauugagcugccaaac

SEQ ID NO: 5004 - RNA, 21 nt, Homo sapiens
uccagauugagcugccaaacg

SEQ ID NO: 5005 - RNA, 21 nt, Homo sapiens
ccagauugagcugccaaacgc

SEQ ID NO: 5006 - RNA, 21 nt, Homo sapiens
cagauugagcugccaaacgcu

SEQ ID NO: 5007 - RNA, 21 nt, Homo sapiens
agauugagcugccaaacgcug

SEQ ID NO: 5008 - RNA, 21 nt, Homo sapiens
gauugagcugccaaacgcuga

SEQ ID NO: 5009 - RNA, 21 nt, Homo sapiens
auugagcugccaaacgcugaa

SEQ ID NO: 5010 - RNA, 21 nt, Homo sapiens
uugagcugccaaacgcugaaa

SEQ ID NO: 5011 - RNA, 21 nt, Homo sapiens
ugagcugccaaacgcugaaau

SEQ ID NO: 5012 - RNA, 21 nt, Homo sapiens
gagcugccaaacgcugaaauu

SEQ ID NO: 5013 - RNA, 21 nt, Homo sapiens
agcugccaaacgcugaaauuc

SEQ ID NO: 5014 - RNA, 21 nt, Homo sapiens
gcugccaaacgcugaaauucu

SEQ ID NO: 5015 - RNA, 21 nt, Homo sapiens
cugccaaacgcugaaauucuc

SEQ ID NO: 5016 - RNA, 21 nt, Homo sapiens
ugccaaacgcugaaauucucc

SEQ ID NO: 5017 - RNA, 21 nt, Homo sapiens
gccaaacgcugaaauucuccu

SEQ ID NO: 5018 - RNA, 21 nt, Homo sapiens
ccaaacgcugaaauucuccuu

SEQ ID NO: 5019 - RNA, 21 nt, Homo sapiens
caaacgcugaaauucuccuuc

SEQ ID NO: 5020 - RNA, 21 nt, Homo sapiens
aaacgcugaaauucuccuucu

SEQ ID NO: 5021 - RNA, 21 nt, Homo sapiens
aacgcugaaauucuccuucug

SEQ ID NO: 5022 - RNA, 21 nt, Homo sapiens
acgcugaaauucuccuucugg

SEQ ID NO: 5023 - RNA, 21 nt, Homo sapiens
cgcugaaauucuccuucuggg

SEQ ID NO: 5024 - RNA, 21 nt, Homo sapiens
gcugaaauucuccuucugggu

SEQ ID NO: 5025 - RNA, 21 nt, Homo sapiens
cugaaauucuccuucuggguu

SEQ ID NO: 5026 - RNA, 21 nt, Homo sapiens
ugaaauucuccuucuggguua

SEQ ID NO: 5027 - RNA, 21 nt, Homo sapiens
gaaauucuccuucuggguuaa

SEQ ID NO: 5028 - RNA, 21 nt, Homo sapiens
aaauucuccuucuggguuaaa

SEQ ID NO: 5029 - RNA, 21 nt, Homo sapiens
aauucuccuucuggguuaaaa

SEQ ID NO: 5030 - RNA, 21 nt, Homo sapiens
auucuccuucuggguuaaaag

SEQ ID NO: 5031 - RNA, 21 nt, Homo sapiens
uucuccuucuggguuaaaagc

SEQ ID NO: 5032 - RNA, 21 nt, Homo sapiens
ucuccuucuggguuaaaagcu

SEQ ID NO: 5033 - RNA, 21 nt, Homo sapiens
cuccuucuggguuaaaagcuu

SEQ ID NO: 5034 - RNA, 21 nt, Homo sapiens
uccuucuggguuaaaagcuug

SEQ ID NO: 5035 - RNA, 21 nt, Homo sapiens
ccuucuggguuaaaagcuugu

SEQ ID NO: 5036 - RNA, 21 nt, Homo sapiens
cuucuggguuaaaagcuuguu

SEQ ID NO: 5037 - RNA, 21 nt, Homo sapiens
uucuggguuaaaagcuuguuu

SEQ ID NO: 5038 - RNA, 21 nt, Homo sapiens
ucuggguuaaaagcuuguuuu

SEQ ID NO: 5039 - RNA, 21 nt, Homo sapiens
cuggguuaaaagcuuguuuua

SEQ ID NO: 5040 - RNA, 21 nt, Homo sapiens
uggguuaaaagcuuguuuuac

SEQ ID NO: 5041 - RNA, 21 nt, Homo sapiens
ggguuaaaagcuuguuuuaca

SEQ ID NO: 5042 - RNA, 21 nt, Homo sapiens
gguuaaaagcuuguuuuacau

SEQ ID NO: 5043 - RNA, 21 nt, Homo sapiens
guuaaaagcuuguuuuacauu

SEQ ID NO: 5044 - RNA, 21 nt, Homo sapiens
uuaaaagcuuguuuuacauuc

SEQ ID NO: 5045 - RNA, 21 nt, Homo sapiens
uaaaagcuuguuuuacauuca

SEQ ID NO: 5046 - RNA, 21 nt, Homo sapiens
aaaagcuuguuuuacauucaa

SEQ ID NO: 5047 - RNA, 21 nt, Homo sapiens
aaagcuuguuuuacauucaaa

SEQ ID NO: 5048 - RNA, 21 nt, Homo sapiens
aagcuuguuuuacauucaaac

SEQ ID NO: 5049 - RNA, 21 nt, Homo sapiens
agcuuguuuuacauucaaacc

SEQ ID NO: 5050 - RNA, 21 nt, Homo sapiens
gcuuguuuuacauucaaaccu

SEQ ID NO: 5051 - RNA, 21 nt, Homo sapiens
cuuguuuuacauucaaaccuu

SEQ ID NO: 5052 - RNA, 21 nt, Homo sapiens
uuguuuuacauucaaaccuuu

SEQ ID NO: 5053 - RNA, 21 nt, Homo sapiens
uguuuuacauucaaaccuuuc

SEQ ID NO: 5054 - RNA, 21 nt, Homo sapiens
guuuuacauucaaaccuuucc

SEQ ID NO: 5055 - RNA, 21 nt, Homo sapiens
uuuuacauucaaaccuuuccc

SEQ ID NO: 5056 - RNA, 21 nt, Homo sapiens
uuuacauucaaaccuuuccca

SEQ ID NO: 5057 - RNA, 21 nt, Homo sapiens
uuacauucaaaccuuucccau

SEQ ID NO: 5058 - RNA, 21 nt, Homo sapiens
uacauucaaaccuuucccauu

SEQ ID NO: 5059 - RNA, 21 nt, Homo sapiens
acauucaaaccuuucccauua

SEQ ID NO: 5060 - RNA, 21 nt, Homo sapiens
cauucaaaccuuucccauuaa

SEQ ID NO: 5061 - RNA, 21 nt, Homo sapiens
auucaaaccuuucccauuaag

SEQ ID NO: 5062 - RNA, 21 nt, Homo sapiens
uucaaaccuuucccauuaagu

SEQ ID NO: 5063 - RNA, 21 nt, Homo sapiens
ucaaaccuuucccauuaagug

SEQ ID NO: 5064 - RNA, 21 nt, Homo sapiens
caaaccuuucccauuaagugc

SEQ ID NO: 5065 - RNA, 21 nt, Homo sapiens
aaaccuuucccauuaagugcu

SEQ ID NO: 5066 - RNA, 21 nt, Homo sapiens
aaccuuucccauuaagugcua

SEQ ID NO: 5067 - RNA, 21 nt, Homo sapiens
accuuucccauuaagugcuaa

SEQ ID NO: 5068 - RNA, 21 nt, Homo sapiens
ccuuucccauuaagugcuaaa

SEQ ID NO: 5069 - RNA, 21 nt, Homo sapiens
cuuucccauuaagugcuaaau

SEQ ID NO: 5070 - RNA, 21 nt, Homo sapiens
uuucccauuaagugcuaaaua

SEQ ID NO: 5071 - RNA, 21 nt, Homo sapiens
uucccauuaagugcuaaauau

SEQ ID NO: 5072 - RNA, 21 nt, Homo sapiens
ucccauuaagugcuaaauauu

SEQ ID NO: 5073 - RNA, 21 nt, Homo sapiens
cccauuaagugcuaaauauuu

SEQ ID NO: 5074 - RNA, 21 nt, Homo sapiens
ccauuaagugcuaaauauuug

SEQ ID NO: 5075 - RNA, 21 nt, Homo sapiens
cauuaagugcuaaauauuugc

SEQ ID NO: 5076 - RNA, 21 nt, Homo sapiens
auuaagugcuaaauauuugcu

SEQ ID NO: 5077 - RNA, 21 nt, Homo sapiens
uuaagugcuaaauauuugcug

SEQ ID NO: 5078 - RNA, 21 nt, Homo sapiens
uaagugcuaaauauuugcuga

SEQ ID NO: 5079 - RNA, 21 nt, Homo sapiens
aagugcuaaauauuugcugaa

SEQ ID NO: 5080 - RNA, 21 nt, Homo sapiens
agugcuaaauauuugcugaau

SEQ ID NO: 5081 - RNA, 21 nt, Homo sapiens
gugcuaaauauuugcugaaug

SEQ ID NO: 5082 - RNA, 21 nt, Homo sapiens
ugcuaaauauuugcugaaugu

SEQ ID NO: 5083 - RNA, 21 nt, Homo sapiens
gcuaaauauuugcugaauguu

SEQ ID NO: 5084 - RNA, 21 nt, Homo sapiens
cuaaauauuugcugaauguug

SEQ ID NO: 5085 - RNA, 21 nt, Homo sapiens
uaaauauuugcugaauguugg

SEQ ID NO: 5086 - RNA, 21 nt, Homo sapiens
aaauauuugcugaauguuggu

SEQ ID NO: 5087 - RNA, 21 nt, Homo sapiens
aauauuugcugaauguugguc

SEQ ID NO: 5088 - RNA, 21 nt, Homo sapiens
auauuugcugaauguuggucg

SEQ ID NO: 5089 - RNA, 21 nt, Homo sapiens
uauuugcugaauguuggucga

SEQ ID NO: 5090 - RNA, 21 nt, Homo sapiens
auuugcugaauguuggucgaa

SEQ ID NO: 5091 - RNA, 21 nt, Homo sapiens
uuugcugaauguuggucgaac

SEQ ID NO: 5092 - RNA, 21 nt, Homo sapiens
uugcugaauguuggucgaacc

SEQ ID NO: 5093 - RNA, 21 nt, Homo sapiens
ugcugaauguuggucgaaccc

SEQ ID NO: 5094 - RNA, 21 nt, Homo sapiens
gcugaauguuggucgaacccg

SEQ ID NO: 5095 - RNA, 21 nt, Homo sapiens
cugaauguuggucgaacccgu

SEQ ID NO: 5096 - RNA, 21 nt, Homo sapiens
ugaauguuggucgaacccgua

SEQ ID NO: 5097 - RNA, 21 nt, Homo sapiens
gaauguuggucgaacccguaa

SEQ ID NO: 5098 - RNA, 21 nt, Homo sapiens
aauguuggucgaacccguaac

SEQ ID NO: 5099 - RNA, 21 nt, Homo sapiens
auguuggucgaacccguaacu

SEQ ID NO: 5100 - RNA, 21 nt, Homo sapiens
uguuggucgaacccguaacug

SEQ ID NO: 5101 - RNA, 21 nt, Homo sapiens
guuggucgaacccguaacugc

SEQ ID NO: 5102 - RNA, 21 nt, Homo sapiens
uuggucgaacccguaacugcu

SEQ ID NO: 5103 - RNA, 21 nt, Homo sapiens
uggucgaacccguaacugcuu

SEQ ID NO: 5104 - RNA, 21 nt, Homo sapiens
ggucgaacccguaacugcuua

SEQ ID NO: 5105 - RNA, 21 nt, Homo sapiens
gucgaacccguaacugcuuag

SEQ ID NO: 5106 - RNA, 21 nt, Homo sapiens
ucgaacccguaacugcuuagg

SEQ ID NO: 5107 - RNA, 21 nt, Homo sapiens
cgaacccguaacugcuuagga

SEQ ID NO: 5108 - RNA, 21 nt, Homo sapiens
gaacccguaacugcuuaggag

SEQ ID NO: 5109 - RNA, 21 nt, Homo sapiens
aacccguaacugcuuaggagc

SEQ ID NO: 5110 - RNA, 21 nt, Homo sapiens
acccguaacugcuuaggagcu

SEQ ID NO: 5111 - RNA, 21 nt, Homo sapiens
cccguaacugcuuaggagcug

SEQ ID NO: 5112 - RNA, 21 nt, Homo sapiens
ccguaacugcuuaggagcugg

SEQ ID NO: 5113 - RNA, 21 nt, Homo sapiens
cguaacugcuuaggagcugga

SEQ ID NO: 5114 - RNA, 21 nt, Homo sapiens
guaacugcuuaggagcuggaa

SEQ ID NO: 5115 - RNA, 21 nt, Homo sapiens
uaacugcuuaggagcuggaag

SEQ ID NO: 5116 - RNA, 21 nt, Homo sapiens
aacugcuuaggagcuggaaga

SEQ ID NO: 5117 - RNA, 21 nt, Homo sapiens
acugcuuaggagcuggaagag

SEQ ID NO: 5118 - RNA, 21 nt, Homo sapiens
cugcuuaggagcuggaagagu

SEQ ID NO: 5119 - RNA, 21 nt, Homo sapiens
ugcuuaggagcuggaagaguu

SEQ ID NO: 5120 - RNA, 21 nt, Homo sapiens
gcuuaggagcuggaagaguuu

SEQ ID NO: 5121 - RNA, 21 nt, Homo sapiens
cuuaggagcuggaagaguuug

SEQ ID NO: 5122 - RNA, 21 nt, Homo sapiens
uuaggagcuggaagaguuugg

SEQ ID NO: 5123 - RNA, 21 nt, Homo sapiens
uaggagcuggaagaguuuggu

SEQ ID NO: 5124 - RNA, 21 nt, Homo sapiens
aggagcuggaagaguuugguu

SEQ ID NO: 5125 - RNA, 21 nt, Homo sapiens
ggagcuggaagaguuugguuu

SEQ ID NO: 5126 - RNA, 21 nt, Homo sapiens
gagcuggaagaguuugguuug

SEQ ID NO: 5127 - RNA, 21 nt, Homo sapiens
agcuggaagaguuugguuugg

SEQ ID NO: 5128 - RNA, 21 nt, Homo sapiens
gcuggaagaguuugguuugga

SEQ ID NO: 5129 - RNA, 21 nt, Homo sapiens
cuggaagaguuugguuuggac

SEQ ID NO: 5130 - RNA, 21 nt, Homo sapiens
uggaagaguuugguuuggacg

SEQ ID NO: 5131 - RNA, 21 nt, Homo sapiens
ggaagaguuugguuuggacgu

SEQ ID NO: 5132 - RNA, 21 nt, Homo sapiens
gaagaguuugguuuggacgug

SEQ ID NO: 5133 - RNA, 21 nt, Homo sapiens
aagaguuugguuuggacgugc

SEQ ID NO: 5134 - RNA, 21 nt, Homo sapiens
agaguuugguuuggacgugcc

SEQ ID NO: 5135 - RNA, 21 nt, Homo sapiens
gaguuugguuuggacgugccg

SEQ ID NO: 5136 - RNA, 21 nt, Homo sapiens
aguuugguuuggacgugccgu

SEQ ID NO: 5137 - RNA, 21 nt, Homo sapiens
guuugguuuggacgugccgua

SEQ ID NO: 5138 - RNA, 21 nt, Homo sapiens
uuugguuuggacgugccguaa

SEQ ID NO: 5139 - RNA, 21 nt, Homo sapiens
uugguuuggacgugccguaac

SEQ ID NO: 5140 - RNA, 21 nt, Homo sapiens
ugguuuggacgugccguaacg

SEQ ID NO: 5141 - RNA, 21 nt, Homo sapiens
gguuuggacgugccguaacgu

SEQ ID NO: 5142 - RNA, 21 nt, Homo sapiens
guuuggacgugccguaacguc

SEQ ID NO: 5143 - RNA, 21 nt, Homo sapiens
uuuggacgugccguaacgucu

SEQ ID NO: 5144 - RNA, 21 nt, Homo sapiens
uuggacgugccguaacgucua

SEQ ID NO: 5145 - RNA, 21 nt, Homo sapiens
uggacgugccguaacgucuaa

SEQ ID NO: 5146 - RNA, 21 nt, Homo sapiens
ggacgugccguaacgucuaau

SEQ ID NO: 5147 - RNA, 21 nt, Homo sapiens
gacgugccguaacgucuaauc

SEQ ID NO: 5148 - RNA, 21 nt, Homo sapiens
acgugccguaacgucuaaucu

SEQ ID NO: 5149 - RNA, 21 nt, Homo sapiens
cgugccguaacgucuaaucuu

SEQ ID NO: 5150 - RNA, 21 nt, Homo sapiens
gugccguaacgucuaaucuug

SEQ ID NO: 5151 - RNA, 21 nt, Homo sapiens
ugccguaacgucuaaucuugu

SEQ ID NO: 5152 - RNA, 21 nt, Homo sapiens
gccguaacgucuaaucuugug

SEQ ID NO: 5153 - RNA, 21 nt, Homo sapiens
ccguaacgucuaaucuugugu

SEQ ID NO: 5154 - RNA, 21 nt, Homo sapiens
cguaacgucuaaucuuguguu

SEQ ID NO: 5155 - RNA, 21 nt, Homo sapiens
guaacgucuaaucuuguguua

SEQ ID NO: 5156 - RNA, 21 nt, Homo sapiens
uaacgucuaaucuuguguuac

SEQ ID NO: 5157 - RNA, 21 nt, Homo sapiens
aacgucuaaucuuguguuaca

SEQ ID NO: 5158 - RNA, 21 nt, Homo sapiens
acgucuaaucuuguguuacau

SEQ ID NO: 5159 - RNA, 21 nt, Homo sapiens
cgucuaaucuuguguuacaug

SEQ ID NO: 5160 - RNA, 21 nt, Homo sapiens
gucuaaucuuguguuacaugu

SEQ ID NO: 5161 - RNA, 21 nt, Homo sapiens
ucuaaucuuguguuacaugua

SEQ ID NO: 5162 - RNA, 21 nt, Homo sapiens
cuaaucuuguguuacauguag

SEQ ID NO: 5163 - RNA, 21 nt, Homo sapiens
uaaucuuguguuacauguagu

SEQ ID NO: 5164 - RNA, 21 nt, Homo sapiens
aaucuuguguuacauguaguc

SEQ ID NO: 5165 - RNA, 21 nt, Homo sapiens
aucuuguguuacauguaguca

SEQ ID NO: 5166 - RNA, 21 nt, Homo sapiens
ucuuguguuacauguagucac

SEQ ID NO: 5167 - RNA, 21 nt, Homo sapiens
cuuguguuacauguagucacu

SEQ ID NO: 5168 - RNA, 21 nt, Homo sapiens
uuguguuacauguagucacuc

SEQ ID NO: 5169 - RNA, 21 nt, Homo sapiens
uguguuacauguagucacucc

SEQ ID NO: 5170 - RNA, 21 nt, Homo sapiens
guguuacauguagucacucca

SEQ ID NO: 5171 - RNA, 21 nt, Homo sapiens
uguuacauguagucacuccag

SEQ ID NO: 5172 - RNA, 21 nt, Homo sapiens
guuacauguagucacuccagc

SEQ ID NO: 5173 - RNA, 21 nt, Homo sapiens
uuacauguagucacuccagcu

SEQ ID NO: 5174 - RNA, 21 nt, Homo sapiens
uacauguagucacuccagcuu

SEQ ID NO: 5175 - RNA, 21 nt, Homo sapiens
acauguagucacuccagcuuc

SEQ ID NO: 5176 - RNA, 21 nt, Homo sapiens
cauguagucacuccagcuuca

SEQ ID NO: 5177 - RNA, 21 nt, Homo sapiens
auguagucacuccagcuucau

SEQ ID NO: 5178 - RNA, 21 nt, Homo sapiens
uguagucacuccagcuucauu

SEQ ID NO: 5179 - RNA, 21 nt, Homo sapiens
guagucacuccagcuucauua

SEQ ID NO: 5180 - RNA, 21 nt, Homo sapiens
uagucacuccagcuucauuaa

SEQ ID NO: 5181 - RNA, 21 nt, Homo sapiens
agucacuccagcuucauuaac

SEQ ID NO: 5182 - RNA, 21 nt, Homo sapiens
gucacuccagcuucauuaacu

SEQ ID NO: 5183 - RNA, 21 nt, Homo sapiens
ucacuccagcuucauuaacug

SEQ ID NO: 5184 - RNA, 21 nt, Homo sapiens
cacuccagcuucauuaacugc

SEQ ID NO: 5185 - RNA, 21 nt, Homo sapiens
acuccagcuucauuaacugcu

SEQ ID NO: 5186 - RNA, 21 nt, Homo sapiens
cuccagcuucauuaacugcug

SEQ ID NO: 5187 - RNA, 21 nt, Homo sapiens
uccagcuucauuaacugcuga

SEQ ID NO: 5188 - RNA, 21 nt, Homo sapiens
ccagcuucauuaacugcugac

SEQ ID NO: 5189 - RNA, 21 nt, Homo sapiens
cagcuucauuaacugcugaca

SEQ ID NO: 5190 - RNA, 21 nt, Homo sapiens
agcuucauuaacugcugacac

SEQ ID NO: 5191 - RNA, 21 nt, Homo sapiens
gcuucauuaacugcugacaca

SEQ ID NO: 5192 - RNA, 21 nt, Homo sapiens
cuucauuaacugcugacacag

SEQ ID NO: 5193 - RNA, 21 nt, Homo sapiens
uucauuaacugcugacacagu

SEQ ID NO: 5194 - RNA, 21 nt, Homo sapiens
ucauuaacugcugacacagua

SEQ ID NO: 5195 - RNA, 21 nt, Homo sapiens
cauuaacugcugacacaguau

SEQ ID NO: 5196 - RNA, 21 nt, Homo sapiens
auuaacugcugacacaguaua

SEQ ID NO: 5197 - RNA, 21 nt, Homo sapiens
uuaacugcugacacaguauac

SEQ ID NO: 5198 - RNA, 21 nt, Homo sapiens
uaacugcugacacaguauacc

SEQ ID NO: 5199 - RNA, 21 nt, Homo sapiens
aacugcugacacaguauacca

SEQ ID NO: 5200 - RNA, 21 nt, Homo sapiens
acugcugacacaguauaccac

SEQ ID NO: 5201 - RNA, 21 nt, Homo sapiens
cugcugacacaguauaccacc

SEQ ID NO: 5202 - RNA, 21 nt, Homo sapiens
ugcugacacaguauaccaccc

SEQ ID NO: 5203 - RNA, 21 nt, Homo sapiens
gcugacacaguauaccaccca

SEQ ID NO: 5204 - RNA, 21 nt, Homo sapiens
cugacacaguauaccacccag

SEQ ID NO: 5205 - RNA, 21 nt, Homo sapiens
ugacacaguauaccacccagc

SEQ ID NO: 5206 - RNA, 21 nt, Homo sapiens
gacacaguauaccacccagca

SEQ ID NO: 5207 - RNA, 21 nt, Homo sapiens
acacaguauaccacccagcau

SEQ ID NO: 5208 - RNA, 21 nt, Homo sapiens
cacaguauaccacccagcauc

SEQ ID NO: 5209 - RNA, 21 nt, Homo sapiens
acaguauaccacccagcaucu

SEQ ID NO: 5210 - RNA, 21 nt, Homo sapiens
caguauaccacccagcaucuu

SEQ ID NO: 5211 - RNA, 21 nt, Homo sapiens
aguauaccacccagcaucuuu

SEQ ID NO: 5212 - RNA, 21 nt, Homo sapiens
guauaccacccagcaucuuuc

SEQ ID NO: 5213 - RNA, 21 nt, Homo sapiens
uauaccacccagcaucuuucu

SEQ ID NO: 5214 - RNA, 21 nt, Homo sapiens
auaccacccagcaucuuucuu

SEQ ID NO: 5215 - RNA, 21 nt, Homo sapiens
uaccacccagcaucuuucuug

SEQ ID NO: 5216 - RNA, 21 nt, Homo sapiens
accacccagcaucuuucuugu

SEQ ID NO: 5217 - RNA, 21 nt, Homo sapiens
ccacccagcaucuuucuuguu

SEQ ID NO: 5218 - RNA, 21 nt, Homo sapiens
cacccagcaucuuucuuguuu

SEQ ID NO: 5219 - RNA, 21 nt, Homo sapiens
acccagcaucuuucuuguuua

SEQ ID NO: 5220 - RNA, 21 nt, Homo sapiens
cccagcaucuuucuuguuuac

SEQ ID NO: 5221 - RNA, 21 nt, Homo sapiens
ccagcaucuuucuuguuuaca

SEQ ID NO: 5222 - RNA, 21 nt, Homo sapiens
cagcaucuuucuuguuuacau

SEQ ID NO: 5223 - RNA, 21 nt, Homo sapiens
agcaucuuucuuguuuacauc

SEQ ID NO: 5224 - RNA, 21 nt, Homo sapiens
gcaucuuucuuguuuacaucu

SEQ ID NO: 5225 - RNA, 21 nt, Homo sapiens
caucuuucuuguuuacaucuu

SEQ ID NO: 5226 - RNA, 21 nt, Homo sapiens
aucuuucuuguuuacaucuuu

SEQ ID NO: 5227 - RNA, 21 nt, Homo sapiens
ucuuucuuguuuacaucuuuu

SEQ ID NO: 5228 - RNA, 21 nt, Homo sapiens
cuuucuuguuuacaucuuuua

SEQ ID NO: 5229 - RNA, 21 nt, Homo sapiens
uuucuuguuuacaucuuuuau

SEQ ID NO: 5230 - RNA, 21 nt, Homo sapiens
uucuuguuuacaucuuuuauc

SEQ ID NO: 5231 - RNA, 21 nt, Homo sapiens
ucuuguuuacaucuuuuauca

SEQ ID NO: 5232 - RNA, 21 nt, Homo sapiens
cuuguuuacaucuuuuaucag

SEQ ID NO: 5233 - RNA, 21 nt, Homo sapiens
uuguuuacaucuuuuaucagu

SEQ ID NO: 5234 - RNA, 21 nt, Homo sapiens
uguuuacaucuuuuaucagua

SEQ ID NO: 5235 - RNA, 21 nt, Homo sapiens
guuuacaucuuuuaucaguaa

SEQ ID NO: 5236 - RNA, 21 nt, Homo sapiens
uuuacaucuuuuaucaguaaa

SEQ ID NO: 5237 - RNA, 21 nt, Homo sapiens
uuacaucuuuuaucaguaaag

SEQ ID NO: 5238 - RNA, 21 nt, Homo sapiens
uacaucuuuuaucaguaaagu

SEQ ID NO: 5239 - RNA, 21 nt, Homo sapiens
acaucuuuuaucaguaaagua

SEQ ID NO: 5240 - RNA, 21 nt, Homo sapiens
caucuuuuaucaguaaaguaa

SEQ ID NO: 5241 - RNA, 21 nt, Homo sapiens
aucuuuuaucaguaaaguaac

SEQ ID NO: 5242 - RNA, 21 nt, Homo sapiens
ucuuuuaucaguaaaguaacu

SEQ ID NO: 5243 - RNA, 21 nt, Homo sapiens
cuuuuaucaguaaaguaacuc

SEQ ID NO: 5244 - RNA, 21 nt, Homo sapiens
uuuuaucaguaaaguaacucu

SEQ ID NO: 5245 - RNA, 21 nt, Homo sapiens
uuuaucaguaaaguaacucuu

SEQ ID NO: 5246 - RNA, 21 nt, Homo sapiens
uuaucaguaaaguaacucuuc

SEQ ID NO: 5247 - RNA, 21 nt, Homo sapiens
uaucaguaaaguaacucuucc

SEQ ID NO: 5248 - RNA, 21 nt, Homo sapiens
aucaguaaaguaacucuucca

SEQ ID NO: 5249 - RNA, 21 nt, Homo sapiens
ucaguaaaguaacucuuccag

SEQ ID NO: 5250 - RNA, 21 nt, Homo sapiens
caguaaaguaacucuuccagu

SEQ ID NO: 5251 - RNA, 21 nt, Homo sapiens
aguaaaguaacucuuccagug

SEQ ID NO: 5252 - RNA, 21 nt, Homo sapiens
guaaaguaacucuuccagugu

SEQ ID NO: 5253 - RNA, 21 nt, Homo sapiens
uaaaguaacucuuccaguguu

SEQ ID NO: 5254 - RNA, 21 nt, Homo sapiens
aaaguaacucuuccaguguua

SEQ ID NO: 5255 - RNA, 21 nt, Homo sapiens
aaguaacucuuccaguguuau

SEQ ID NO: 5256 - RNA, 21 nt, Homo sapiens
aguaacucuuccaguguuauc

SEQ ID NO: 5257 - RNA, 21 nt, Homo sapiens
guaacucuuccaguguuaucu

SEQ ID NO: 5258 - RNA, 21 nt, Homo sapiens
uaacucuuccaguguuaucuu

SEQ ID NO: 5259 - RNA, 21 nt, Homo sapiens
aacucuuccaguguuaucuug

SEQ ID NO: 5260 - RNA, 21 nt, Homo sapiens
acucuuccaguguuaucuuga

SEQ ID NO: 5261 - RNA, 21 nt, Homo sapiens
cucuuccaguguuaucuugau

SEQ ID NO: 5262 - RNA, 21 nt, Homo sapiens
ucuuccaguguuaucuugaua

SEQ ID NO: 5263 - RNA, 21 nt, Homo sapiens
cuuccaguguuaucuugauau

SEQ ID NO: 5264 - RNA, 21 nt, Homo sapiens
uuccaguguuaucuugauaua

SEQ ID NO: 5265 - RNA, 21 nt, Homo sapiens
uccaguguuaucuugauauaa

SEQ ID NO: 5266 - RNA, 21 nt, Homo sapiens
ccaguguuaucuugauauaag

SEQ ID NO: 5267 - RNA, 21 nt, Homo sapiens
caguguuaucuugauauaagc

SEQ ID NO: 5268 - RNA, 21 nt, Homo sapiens
aguguuaucuugauauaagcu

SEQ ID NO: 5269 - RNA, 21 nt, Homo sapiens
guguuaucuugauauaagcuu

SEQ ID NO: 5270 - RNA, 21 nt, Homo sapiens
uguuaucuugauauaagcuua

SEQ ID NO: 5271 - RNA, 21 nt, Homo sapiens
guuaucuugauauaagcuuau

SEQ ID NO: 5272 - RNA, 21 nt, Homo sapiens
uuaucuugauauaagcuuauu

SEQ ID NO: 5273 - RNA, 21 nt, Homo sapiens
uaucuugauauaagcuuauuc

SEQ ID NO: 5274 - RNA, 21 nt, Homo sapiens
aucuugauauaagcuuauucg

SEQ ID NO: 5275 - RNA, 21 nt, Homo sapiens
ucuugauauaagcuuauucgg

SEQ ID NO: 5276 - RNA, 21 nt, Homo sapiens
cuugauauaagcuuauucggu

SEQ ID NO: 5277 - RNA, 21 nt, Homo sapiens
uugauauaagcuuauucgguc

SEQ ID NO: 5278 - RNA, 21 nt, Homo sapiens
ugauauaagcuuauucgguca

SEQ ID NO: 5279 - RNA, 21 nt, Homo sapiens
gauauaagcuuauucggucag

SEQ ID NO: 5280 - RNA, 21 nt, Homo sapiens
auauaagcuuauucggucagu

SEQ ID NO: 5281 - RNA, 21 nt, Homo sapiens
uauaagcuuauucggucagug

SEQ ID NO: 5282 - RNA, 21 nt, Homo sapiens
auaagcuuauucggucagugu

SEQ ID NO: 5283 - RNA, 21 nt, Homo sapiens
uaagcuuauucggucaguguu

SEQ ID NO: 5284 - RNA, 21 nt, Homo sapiens
aagcuuauucggucaguguug

SEQ ID NO: 5285 - RNA, 21 nt, Homo sapiens
agcuuauucggucaguguuga

SEQ ID NO: 5286 - RNA, 21 nt, Homo sapiens
gcuuauucggucaguguugaa

SEQ ID NO: 5287 - RNA, 21 nt, Homo sapiens
cuuauucggucaguguugaau

SEQ ID NO: 5288 - RNA, 21 nt, Homo sapiens
uuauucggucaguguugaauu

SEQ ID NO: 5289 - RNA, 21 nt, Homo sapiens
uauucggucaguguugaauug

SEQ ID NO: 5290 - RNA, 21 nt, Homo sapiens
auucggucaguguugaauugu

SEQ ID NO: 5291 - RNA, 21 nt, Homo sapiens
uucggucaguguugaauugua

SEQ ID NO: 5292 - RNA, 21 nt, Homo sapiens
ucggucaguguugaauuguac

SEQ ID NO: 5293 - RNA, 21 nt, Homo sapiens
cggucaguguugaauuguacc

SEQ ID NO: 5294 - RNA, 21 nt, Homo sapiens
ggucaguguugaauuguacca

SEQ ID NO: 5295 - RNA, 21 nt, Homo sapiens
gucaguguugaauuguaccau

SEQ ID NO: 5296 - RNA, 21 nt, Homo sapiens
ucaguguugaauuguaccauu

SEQ ID NO: 5297 - RNA, 21 nt, Homo sapiens
caguguugaauuguaccauuu

SEQ ID NO: 5298 - RNA, 21 nt, Homo sapiens
aguguugaauuguaccauuuc

SEQ ID NO: 5299 - RNA, 21 nt, Homo sapiens
guguugaauuguaccauuuca

SEQ ID NO: 5300 - RNA, 21 nt, Homo sapiens
uguugaauuguaccauuucau

SEQ ID NO: 5301 - RNA, 21 nt, Homo sapiens
guugaauuguaccauuucauu

SEQ ID NO: 5302 - RNA, 21 nt, Homo sapiens
uugaauuguaccauuucauua

SEQ ID NO: 5303 - RNA, 21 nt, Homo sapiens
ugaauuguaccauuucauuau

SEQ ID NO: 5304 - RNA, 21 nt, Homo sapiens
gaauuguaccauuucauuauu

SEQ ID NO: 5305 - RNA, 21 nt, Homo sapiens
aauuguaccauuucauuauuu

SEQ ID NO: 5306 - RNA, 21 nt, Homo sapiens
auuguaccauuucauuauuuc

SEQ ID NO: 5307 - RNA, 21 nt, Homo sapiens
uuguaccauuucauuauuucu

SEQ ID NO: 5308 - RNA, 21 nt, Homo sapiens
uguaccauuucauuauuucuu

SEQ ID NO: 5309 - RNA, 21 nt, Homo sapiens
guaccauuucauuauuucuuu

SEQ ID NO: 5310 - RNA, 21 nt, Homo sapiens
uaccauuucauuauuucuuuu

SEQ ID NO: 5311 - RNA, 21 nt, Homo sapiens
accauuucauuauuucuuuuc

SEQ ID NO: 5312 - RNA, 21 nt, Homo sapiens
ccauuucauuauuucuuuucc

SEQ ID NO: 5313 - RNA, 21 nt, Homo sapiens
cauuucauuauuucuuuucca

SEQ ID NO: 5314 - RNA, 21 nt, Homo sapiens
auuucauuauuucuuuuccag

SEQ ID NO: 5315 - RNA, 21 nt, Homo sapiens
uuucauuauuucuuuuccaga

SEQ ID NO: 5316 - RNA, 21 nt, Homo sapiens
uucauuauuucuuuuccagaa

SEQ ID NO: 5317 - RNA, 21 nt, Homo sapiens
ucauuauuucuuuuccagaaa

SEQ ID NO: 5318 - RNA, 21 nt, Homo sapiens
cauuauuucuuuuccagaaaa

SEQ ID NO: 5319 - RNA, 21 nt, Homo sapiens
auuauuucuuuuccagaaaag

SEQ ID NO: 5320 - RNA, 21 nt, Homo sapiens
uuauuucuuuuccagaaaagc

SEQ ID NO: 5321 - RNA, 21 nt, Homo sapiens
uauuucuuuuccagaaaagcu

SEQ ID NO: 5322 - RNA, 21 nt, Homo sapiens
auuucuuuuccagaaaagcuu

SEQ ID NO: 5323 - RNA, 21 nt, Homo sapiens
uuucuuuuccagaaaagcuuu

SEQ ID NO: 5324 - RNA, 21 nt, Homo sapiens
uucuuuuccagaaaagcuuug

SEQ ID NO: 5325 - RNA, 21 nt, Homo sapiens
ucuuuuccagaaaagcuuugg

SEQ ID NO: 5326 - RNA, 21 nt, Homo sapiens
cuuuuccagaaaagcuuuggu

SEQ ID NO: 5327 - RNA, 21 nt, Homo sapiens
uuuuccagaaaagcuuuggug

SEQ ID NO: 5328 - RNA, 21 nt, Homo sapiens
uuuccagaaaagcuuuggugg

SEQ ID NO: 5329 - RNA, 21 nt, Homo sapiens
uuccagaaaagcuuuggugga

SEQ ID NO: 5330 - RNA, 21 nt, Homo sapiens
uccagaaaagcuuugguggag

SEQ ID NO: 5331 - RNA, 21 nt, Homo sapiens
ccagaaaagcuuugguggagg

SEQ ID NO: 5332 - RNA, 21 nt, Homo sapiens
cagaaaagcuuugguggaggu

SEQ ID NO: 5333 - RNA, 21 nt, Homo sapiens
agaaaagcuuugguggaggua

SEQ ID NO: 5334 - RNA, 21 nt, Homo sapiens
gaaaagcuuugguggagguau

SEQ ID NO: 5335 - RNA, 21 nt, Homo sapiens
aaaagcuuugguggagguaua

SEQ ID NO: 5336 - RNA, 21 nt, Homo sapiens
aaagcuuugguggagguauag

SEQ ID NO: 5337 - RNA, 21 nt, Homo sapiens
aagcuuugguggagguauagc

SEQ ID NO: 5338 - RNA, 21 nt, Homo sapiens
agcuuugguggagguauagcc

SEQ ID NO: 5339 - RNA, 21 nt, Homo sapiens
gcuuugguggagguauagccg

SEQ ID NO: 5340 - RNA, 21 nt, Homo sapiens
cuuugguggagguauagccga

SEQ ID NO: 5341 - RNA, 21 nt, Homo sapiens
uuugguggagguauagccgag

SEQ ID NO: 5342 - RNA, 21 nt, Homo sapiens
uugguggagguauagccgaga

SEQ ID NO: 5343 - RNA, 21 nt, Homo sapiens
ugguggagguauagccgagau

SEQ ID NO: 5344 - RNA, 21 nt, Homo sapiens
gguggagguauagccgagauc

SEQ ID NO: 5345 - RNA, 21 nt, Homo sapiens
guggagguauagccgagaucu

SEQ ID NO: 5346 - RNA, 21 nt, Homo sapiens
uggagguauagccgagaucug

SEQ ID NO: 5347 - RNA, 21 nt, Homo sapiens
ggagguauagccgagaucugg

SEQ ID NO: 5348 - RNA, 21 nt, Homo sapiens
gagguauagccgagaucuggc

SEQ ID NO: 5349 - RNA, 21 nt, Homo sapiens
agguauagccgagaucuggca

SEQ ID NO: 5350 - RNA, 21 nt, Homo sapiens
gguauagccgagaucuggcau

SEQ ID NO: 5351 - RNA, 21 nt, Homo sapiens
guauagccgagaucuggcauu

SEQ ID NO: 5352 - RNA, 21 nt, Homo sapiens
uauagccgagaucuggcauuc

SEQ ID NO: 5353 - RNA, 21 nt, Homo sapiens
auagccgagaucuggcauucu

SEQ ID NO: 5354 - RNA, 21 nt, Homo sapiens
uagccgagaucuggcauucua

SEQ ID NO: 5355 - RNA, 21 nt, Homo sapiens
agccgagaucuggcauucuag

SEQ ID NO: 5356 - RNA, 21 nt, Homo sapiens
gccgagaucuggcauucuagu

SEQ ID NO: 5357 - RNA, 21 nt, Homo sapiens
ccgagaucuggcauucuaguu

SEQ ID NO: 5358 - RNA, 21 nt, Homo sapiens
cgagaucuggcauucuaguuu

SEQ ID NO: 5359 - RNA, 21 nt, Homo sapiens
gagaucuggcauucuaguuuc

SEQ ID NO: 5360 - RNA, 21 nt, Homo sapiens
agaucuggcauucuaguuuca

SEQ ID NO: 5361 - RNA, 21 nt, Homo sapiens
gaucuggcauucuaguuucac

SEQ ID NO: 5362 - RNA, 21 nt, Homo sapiens
aucuggcauucuaguuucacu

SEQ ID NO: 5363 - RNA, 21 nt, Homo sapiens
ucuggcauucuaguuucacug

SEQ ID NO: 5364 - RNA, 21 nt, Homo sapiens
cuggcauucuaguuucacuga

SEQ ID NO: 5365 - RNA, 21 nt, Homo sapiens
uggcauucuaguuucacugaa

SEQ ID NO: 5366 - RNA, 21 nt, Homo sapiens
ggcauucuaguuucacugaau

SEQ ID NO: 5367 - RNA, 21 nt, Homo sapiens
gcauucuaguuucacugaauc

SEQ ID NO: 5368 - RNA, 21 nt, Homo sapiens
cauucuaguuucacugaaucu

SEQ ID NO: 5369 - RNA, 21 nt, Homo sapiens
auucuaguuucacugaaucuc

SEQ ID NO: 5370 - RNA, 21 nt, Homo sapiens
uucuaguuucacugaaucucc

SEQ ID NO: 5371 - RNA, 21 nt, Homo sapiens
ucuaguuucacugaaucuccc

SEQ ID NO: 5372 - RNA, 21 nt, Homo sapiens
cuaguuucacugaaucucccu

SEQ ID NO: 5373 - RNA, 21 nt, Homo sapiens
uaguuucacugaaucucccuc

SEQ ID NO: 5374 - RNA, 21 nt, Homo sapiens
aguuucacugaaucucccucu

SEQ ID NO: 5375 - RNA, 21 nt, Homo sapiens
guuucacugaaucucccucua

SEQ ID NO: 5376 - RNA, 21 nt, Homo sapiens
uuucacugaaucucccucuaa

SEQ ID NO: 5377 - RNA, 21 nt, Homo sapiens
uucacugaaucucccucuaaa

SEQ ID NO: 5378 - RNA, 21 nt, Homo sapiens
ucacugaaucucccucuaaaa

SEQ ID NO: 5379 - RNA, 21 nt, Homo sapiens
cacugaaucucccucuaaaac

SEQ ID NO: 5380 - RNA, 21 nt, Homo sapiens
acugaaucucccucuaaaacu

SEQ ID NO: 5381 - RNA, 21 nt, Homo sapiens
cugaaucucccucuaaaacuu

SEQ ID NO: 5382 - RNA, 21 nt, Homo sapiens
ugaaucucccucuaaaacuuu

SEQ ID NO: 5383 - RNA, 21 nt, Homo sapiens
gaaucucccucuaaaacuuuu

SEQ ID NO: 5384 - RNA, 21 nt, Homo sapiens
aaucucccucuaaaacuuuuu

SEQ ID NO: 5385 - RNA, 21 nt, Homo sapiens
aucucccucuaaaacuuuuuu

SEQ ID NO: 5386 - RNA, 21 nt, Homo sapiens
ucucccucuaaaacuuuuuug

SEQ ID NO: 5387 - RNA, 21 nt, Homo sapiens
cucccucuaaaacuuuuuugc

SEQ ID NO: 5388 - RNA, 21 nt, Homo sapiens
ucccucuaaaacuuuuuugcu

SEQ ID NO: 5389 - RNA, 21 nt, Homo sapiens
cccucuaaaacuuuuuugcuc

SEQ ID NO: 5390 - RNA, 21 nt, Homo sapiens
ccucuaaaacuuuuuugcucu

SEQ ID NO: 5391 - RNA, 21 nt, Homo sapiens
cucuaaaacuuuuuugcucug

SEQ ID NO: 5392 - RNA, 21 nt, Homo sapiens
ucuaaaacuuuuuugcucugu

SEQ ID NO: 5393 - RNA, 21 nt, Homo sapiens
cuaaaacuuuuuugcucugug

SEQ ID NO: 5394 - RNA, 21 nt, Homo sapiens
uaaaacuuuuuugcucugugg

SEQ ID NO: 5395 - RNA, 21 nt, Homo sapiens
aaaacuuuuuugcucuguggu

SEQ ID NO: 5396 - RNA, 21 nt, Homo sapiens
aaacuuuuuugcucugugguu

SEQ ID NO: 5397 - RNA, 21 nt, Homo sapiens
aacuuuuuugcucugugguuu

SEQ ID NO: 5398 - RNA, 21 nt, Homo sapiens
acuuuuuugcucugugguuug

SEQ ID NO: 5399 - RNA, 21 nt, Homo sapiens
cuuuuuugcucugugguuugu

SEQ ID NO: 5400 - RNA, 21 nt, Homo sapiens
uuuuuugcucugugguuugua

SEQ ID NO: 5401 - RNA, 21 nt, Homo sapiens
uuuuugcucugugguuuguag

SEQ ID NO: 5402 - RNA, 21 nt, Homo sapiens
uuuugcucugugguuuguaga

SEQ ID NO: 5403 - RNA, 21 nt, Homo sapiens
uuugcucugugguuuguagau

SEQ ID NO: 5404 - RNA, 21 nt, Homo sapiens
uugcucugugguuuguagaua

SEQ ID NO: 5405 - RNA, 21 nt, Homo sapiens
ugcucugugguuuguagauaa

SEQ ID NO: 5406 - RNA, 21 nt, Homo sapiens
gcucugugguuuguagauaaa

SEQ ID NO: 5407 - RNA, 21 nt, Homo sapiens
cucugugguuuguagauaaac

SEQ ID NO: 5408 - RNA, 21 nt, Homo sapiens
ucugugguuuguagauaaaca

SEQ ID NO: 5409 - RNA, 21 nt, Homo sapiens
cugugguuuguagauaaacau

SEQ ID NO: 5410 - RNA, 21 nt, Homo sapiens
ugugguuuguagauaaacauu

SEQ ID NO: 5411 - RNA, 21 nt, Homo sapiens
gugguuuguagauaaacauug

SEQ ID NO: 5412 - RNA, 21 nt, Homo sapiens
ugguuuguagauaaacauugg

SEQ ID NO: 5413 - RNA, 21 nt, Homo sapiens
gguuuguagauaaacauuggu

SEQ ID NO: 5414 - RNA, 21 nt, Homo sapiens
guuuguagauaaacauuggug

SEQ ID NO: 5415 - RNA, 21 nt, Homo sapiens
uuuguagauaaacauuggugc

SEQ ID NO: 5416 - RNA, 21 nt, Homo sapiens
uuguagauaaacauuggugcu

SEQ ID NO: 5417 - RNA, 21 nt, Homo sapiens
uguagauaaacauuggugcuc

SEQ ID NO: 5418 - RNA, 21 nt, Homo sapiens
guagauaaacauuggugcucu

SEQ ID NO: 5419 - RNA, 21 nt, Homo sapiens
uagauaaacauuggugcucuu

SEQ ID NO: 5420 - RNA, 21 nt, Homo sapiens
agauaaacauuggugcucuuu

SEQ ID NO: 5421 - RNA, 21 nt, Homo sapiens
gauaaacauuggugcucuuuu

SEQ ID NO: 5422 - RNA, 21 nt, Homo sapiens
auaaacauuggugcucuuuua

SEQ ID NO: 5423 - RNA, 21 nt, Homo sapiens
uaaacauuggugcucuuuuau

SEQ ID NO: 5424 - RNA, 21 nt, Homo sapiens
aaacauuggugcucuuuuaug

SEQ ID NO: 5425 - RNA, 21 nt, Homo sapiens
aacauuggugcucuuuuaugu

SEQ ID NO: 5426 - RNA, 21 nt, Homo sapiens
acauuggugcucuuuuauguu

SEQ ID NO: 5427 - RNA, 21 nt, Homo sapiens
cauuggugcucuuuuauguuc

SEQ ID NO: 5428 - RNA, 21 nt, Homo sapiens
auuggugcucuuuuauguucu

SEQ ID NO: 5429 - RNA, 21 nt, Homo sapiens
uuggugcucuuuuauguucuu

SEQ ID NO: 5430 - RNA, 21 nt, Homo sapiens
uggugcucuuuuauguucuuu

SEQ ID NO: 5431 - RNA, 21 nt, Homo sapiens
ggugcucuuuuauguucuuuu

SEQ ID NO: 5432 - RNA, 21 nt, Homo sapiens
gugcucuuuuauguucuuuug

SEQ ID NO: 5433 - RNA, 21 nt, Homo sapiens
ugcucuuuuauguucuuuugc

SEQ ID NO: 5434 - RNA, 21 nt, Homo sapiens
gcucuuuuauguucuuuugca

SEQ ID NO: 5435 - RNA, 21 nt, Homo sapiens
cucuuuuauguucuuuugcaa

SEQ ID NO: 5436 - RNA, 21 nt, Homo sapiens
ucuuuuauguucuuuugcaag

SEQ ID NO: 5437 - RNA, 21 nt, Homo sapiens
cuuuuauguucuuuugcaagg

SEQ ID NO: 5438 - RNA, 21 nt, Homo sapiens
uuuuauguucuuuugcaagga

SEQ ID NO: 5439 - RNA, 21 nt, Homo sapiens
uuuauguucuuuugcaaggac

SEQ ID NO: 5440 - RNA, 21 nt, Homo sapiens
uuauguucuuuugcaaggaca

SEQ ID NO: 5441 - RNA, 21 nt, Homo sapiens
uauguucuuuugcaaggacau

SEQ ID NO: 5442 - RNA, 21 nt, Homo sapiens
auguucuuuugcaaggacauc

SEQ ID NO: 5443 - RNA, 21 nt, Homo sapiens
uguucuuuugcaaggacaucc

SEQ ID NO: 5444 - RNA, 21 nt, Homo sapiens
guucuuuugcaaggacaucca

SEQ ID NO: 5445 - RNA, 21 nt, Homo sapiens
uucuuuugcaaggacauccag

SEQ ID NO: 5446 - RNA, 21 nt, Homo sapiens
ucuuuugcaaggacauccagc

SEQ ID NO: 5447 - RNA, 21 nt, Homo sapiens
cuuuugcaaggacauccagcu

SEQ ID NO: 5448 - RNA, 21 nt, Homo sapiens
uuuugcaaggacauccagcug

SEQ ID NO: 5449 - RNA, 21 nt, Homo sapiens
uuugcaaggacauccagcugc

SEQ ID NO: 5450 - RNA, 21 nt, Homo sapiens
uugcaaggacauccagcugca

SEQ ID NO: 5451 - RNA, 21 nt, Homo sapiens
ugcaaggacauccagcugcac

SEQ ID NO: 5452 - RNA, 21 nt, Homo sapiens
gcaaggacauccagcugcaca

SEQ ID NO: 5453 - RNA, 21 nt, Homo sapiens
caaggacauccagcugcacag

SEQ ID NO: 5454 - RNA, 21 nt, Homo sapiens
aaggacauccagcugcacagu

SEQ ID NO: 5455 - RNA, 21 nt, Homo sapiens
aggacauccagcugcacagug

SEQ ID NO: 5456 - RNA, 21 nt, Homo sapiens
ggacauccagcugcacaguga

SEQ ID NO: 5457 - RNA, 21 nt, Homo sapiens
gacauccagcugcacagugaa

SEQ ID NO: 5458 - RNA, 21 nt, Homo sapiens
acauccagcugcacagugaag

SEQ ID NO: 5459 - RNA, 21 nt, Homo sapiens
cauccagcugcacagugaagg

SEQ ID NO: 5460 - RNA, 21 nt, Homo sapiens
auccagcugcacagugaaggu

SEQ ID NO: 5461 - RNA, 21 nt, Homo sapiens
uccagcugcacagugaaggug

SEQ ID NO: 5462 - RNA, 21 nt, Homo sapiens
ccagcugcacagugaaggugg

SEQ ID NO: 5463 - RNA, 21 nt, Homo sapiens
cagcugcacagugaagguggc

SEQ ID NO: 5464 - RNA, 21 nt, Homo sapiens
agcugcacagugaagguggcu

SEQ ID NO: 5465 - RNA, 21 nt, Homo sapiens
gcugcacagugaagguggcuu

SEQ ID NO: 5466 - RNA, 21 nt, Homo sapiens
cugcacagugaagguggcuuc

SEQ ID NO: 5467 - RNA, 21 nt, Homo sapiens
ugcacagugaagguggcuucu

SEQ ID NO: 5468 - RNA, 21 nt, Homo sapiens
gcacagugaagguggcuucuc

SEQ ID NO: 5469 - RNA, 21 nt, Homo sapiens
cacagugaagguggcuucucc

SEQ ID NO: 5470 - RNA, 21 nt, Homo sapiens
acagugaagguggcuucuccu

SEQ ID NO: 5471 - RNA, 21 nt, Homo sapiens
cagugaagguggcuucuccug

SEQ ID NO: 5472 - RNA, 21 nt, Homo sapiens
agugaagguggcuucuccugc

SEQ ID NO: 5473 - RNA, 21 nt, Homo sapiens
gugaagguggcuucuccugcu

SEQ ID NO: 5474 - RNA, 21 nt, Homo sapiens
ugaagguggcuucuccugcuc

SEQ ID NO: 5475 - RNA, 21 nt, Homo sapiens
gaagguggcuucuccugcucu

SEQ ID NO: 5476 - RNA, 21 nt, Homo sapiens
aagguggcuucuccugcucua

SEQ ID NO: 5477 - RNA, 21 nt, Homo sapiens
agguggcuucuccugcucuau

SEQ ID NO: 5478 - RNA, 21 nt, Homo sapiens
gguggcuucuccugcucuauu

SEQ ID NO: 5479 - RNA, 21 nt, Homo sapiens
guggcuucuccugcucuauuc

SEQ ID NO: 5480 - RNA, 21 nt, Homo sapiens
uggcuucuccugcucuauucu

SEQ ID NO: 5481 - RNA, 21 nt, Homo sapiens
ggcuucuccugcucuauucuu

SEQ ID NO: 5482 - RNA, 21 nt, Homo sapiens
gcuucuccugcucuauucuug

SEQ ID NO: 5483 - RNA, 21 nt, Homo sapiens
cuucuccugcucuauucuugg

SEQ ID NO: 5484 - RNA, 21 nt, Homo sapiens
uucuccugcucuauucuuggc

SEQ ID NO: 5485 - RNA, 21 nt, Homo sapiens
ucuccugcucuauucuuggca

SEQ ID NO: 5486 - RNA, 21 nt, Homo sapiens
cuccugcucuauucuuggcaa

SEQ ID NO: 5487 - RNA, 21 nt, Homo sapiens
uccugcucuauucuuggcaac

SEQ ID NO: 5488 - RNA, 21 nt, Homo sapiens
ccugcucuauucuuggcaaca

SEQ ID NO: 5489 - RNA, 21 nt, Homo sapiens
cugcucuauucuuggcaacac

SEQ ID NO: 5490 - RNA, 21 nt, Homo sapiens
ugcucuauucuuggcaacaca

SEQ ID NO: 5491 - RNA, 21 nt, Homo sapiens
gcucuauucuuggcaacacau

SEQ ID NO: 5492 - RNA, 21 nt, Homo sapiens
cucuauucuuggcaacacaug

SEQ ID NO: 5493 - RNA, 21 nt, Homo sapiens
ucuauucuuggcaacacaugc

SEQ ID NO: 5494 - RNA, 21 nt, Homo sapiens
cuauucuuggcaacacaugca

SEQ ID NO: 5495 - RNA, 21 nt, Homo sapiens
uauucuuggcaacacaugcau

SEQ ID NO: 5496 - RNA, 21 nt, Homo sapiens
auucuuggcaacacaugcaua

SEQ ID NO: 5497 - RNA, 21 nt, Homo sapiens
uucuuggcaacacaugcauaa

SEQ ID NO: 5498 - RNA, 21 nt, Homo sapiens
ucuuggcaacacaugcauaag

SEQ ID NO: 5499 - RNA, 21 nt, Homo sapiens
cuuggcaacacaugcauaagc

SEQ ID NO: 5500 - RNA, 21 nt, Homo sapiens
uuggcaacacaugcauaagcc

SEQ ID NO: 5501 - RNA, 21 nt, Homo sapiens
uggcaacacaugcauaagccc

SEQ ID NO: 5502 - RNA, 21 nt, Homo sapiens
ggcaacacaugcauaagcccc

SEQ ID NO: 5503 - RNA, 21 nt, Homo sapiens
gcaacacaugcauaagccccu

SEQ ID NO: 5504 - RNA, 21 nt, Homo sapiens
caacacaugcauaagccccug

SEQ ID NO: 5505 - RNA, 21 nt, Homo sapiens
aacacaugcauaagccccugc

SEQ ID NO: 5506 - RNA, 21 nt, Homo sapiens
acacaugcauaagccccugca

SEQ ID NO: 5507 - RNA, 21 nt, Homo sapiens
cacaugcauaagccccugcau

SEQ ID NO: 5508 - RNA, 21 nt, Homo sapiens
acaugcauaagccccugcauc

SEQ ID NO: 5509 - RNA, 21 nt, Homo sapiens
caugcauaagccccugcaucu

SEQ ID NO: 5510 - RNA, 21 nt, Homo sapiens
augcauaagccccugcaucug

SEQ ID NO: 5511 - RNA, 21 nt, Homo sapiens
ugcauaagccccugcaucuga

SEQ ID NO: 5512 - RNA, 21 nt, Homo sapiens
gcauaagccccugcaucugaa

SEQ ID NO: 5513 - RNA, 21 nt, Homo sapiens
cauaagccccugcaucugaag

SEQ ID NO: 5514 - RNA, 21 nt, Homo sapiens
auaagccccugcaucugaagc

SEQ ID NO: 5515 - RNA, 21 nt, Homo sapiens
uaagccccugcaucugaagcu

SEQ ID NO: 5516 - RNA, 21 nt, Homo sapiens
aagccccugcaucugaagcuc

SEQ ID NO: 5517 - RNA, 21 nt, Homo sapiens
agccccugcaucugaagcucu

SEQ ID NO: 5518 - RNA, 21 nt, Homo sapiens
gccccugcaucugaagcucug

SEQ ID NO: 5519 - RNA, 21 nt, Homo sapiens
ccccugcaucugaagcucuga

SEQ ID NO: 5520 - RNA, 21 nt, Homo sapiens
cccugcaucugaagcucugac

SEQ ID NO: 5521 - RNA, 21 nt, Homo sapiens
ccugcaucugaagcucugacu

SEQ ID NO: 5522 - RNA, 21 nt, Homo sapiens
cugcaucugaagcucugacua

SEQ ID NO: 5523 - RNA, 21 nt, Homo sapiens
ugcaucugaagcucugacuac

SEQ ID NO: 5524 - RNA, 21 nt, Homo sapiens
gcaucugaagcucugacuacu

SEQ ID NO: 5525 - RNA, 21 nt, Homo sapiens
caucugaagcucugacuacuu

SEQ ID NO: 5526 - RNA, 21 nt, Homo sapiens
aucugaagcucugacuacuuc

SEQ ID NO: 5527 - RNA, 21 nt, Homo sapiens
ucugaagcucugacuacuuca

SEQ ID NO: 5528 - RNA, 21 nt, Homo sapiens
cugaagcucugacuacuucaa

SEQ ID NO: 5529 - RNA, 21 nt, Homo sapiens
ugaagcucugacuacuucaaa

SEQ ID NO: 5530 - RNA, 21 nt, Homo sapiens
gaagcucugacuacuucaaag

SEQ ID NO: 5531 - RNA, 21 nt, Homo sapiens
aagcucugacuacuucaaaga

SEQ ID NO: 5532 - RNA, 21 nt, Homo sapiens
agcucugacuacuucaaagau

SEQ ID NO: 5533 - RNA, 21 nt, Homo sapiens
gcucugacuacuucaaagaug

SEQ ID NO: 5534 - RNA, 21 nt, Homo sapiens
cucugacuacuucaaagauga

SEQ ID NO: 5535 - RNA, 21 nt, Homo sapiens
ucugacuacuucaaagaugag

SEQ ID NO: 5536 - RNA, 21 nt, Homo sapiens
cugacuacuucaaagaugagu

SEQ ID NO: 5537 - RNA, 21 nt, Homo sapiens
ugacuacuucaaagaugagug

SEQ ID NO: 5538 - RNA, 21 nt, Homo sapiens
gacuacuucaaagaugaguga

SEQ ID NO: 5539 - RNA, 21 nt, Homo sapiens
acuacuucaaagaugagugaa

SEQ ID NO: 5540 - RNA, 21 nt, Homo sapiens
cuacuucaaagaugagugaau

SEQ ID NO: 5541 - RNA, 21 nt, Homo sapiens
uacuucaaagaugagugaaug

SEQ ID NO: 5542 - RNA, 21 nt, Homo sapiens
acuucaaagaugagugaauga

SEQ ID NO: 5543 - RNA, 21 nt, Homo sapiens
cuucaaagaugagugaaugaa

SEQ ID NO: 5544 - RNA, 21 nt, Homo sapiens
uucaaagaugagugaaugaag

SEQ ID NO: 5545 - RNA, 21 nt, Homo sapiens
ucaaagaugagugaaugaaga

SEQ ID NO: 5546 - RNA, 21 nt, Homo sapiens
caaagaugagugaaugaagac

SEQ ID NO: 5547 - RNA, 21 nt, Homo sapiens
aaagaugagugaaugaagacc

SEQ ID NO: 5548 - RNA, 21 nt, Homo sapiens
aagaugagugaaugaagaccc

SEQ ID NO: 5549 - RNA, 21 nt, Homo sapiens
agaugagugaaugaagacccu

SEQ ID NO: 5550 - RNA, 21 nt, Homo sapiens
gaugagugaaugaagacccuu

SEQ ID NO: 5551 - RNA, 21 nt, Homo sapiens
augagugaaugaagacccuuc

SEQ ID NO: 5552 - RNA, 21 nt, Homo sapiens
ugagugaaugaagacccuucu

SEQ ID NO: 5553 - RNA, 21 nt, Homo sapiens
gagugaaugaagacccuucuc

SEQ ID NO: 5554 - RNA, 21 nt, Homo sapiens
agugaaugaagacccuucuca

SEQ ID NO: 5555 - RNA, 21 nt, Homo sapiens
gugaaugaagacccuucucag

SEQ ID NO: 5556 - RNA, 21 nt, Homo sapiens
ugaaugaagacccuucucaga

SEQ ID NO: 5557 - RNA, 21 nt, Homo sapiens
gaaugaagacccuucucagac

SEQ ID NO: 5558 - RNA, 21 nt, Homo sapiens
aaugaagacccuucucagaca

SEQ ID NO: 5559 - RNA, 21 nt, Homo sapiens
augaagacccuucucagacac

SEQ ID NO: 5560 - RNA, 21 nt, Homo sapiens
ugaagacccuucucagacacu

SEQ ID NO: 5561 - RNA, 21 nt, Homo sapiens
gaagacccuucucagacacua

SEQ ID NO: 5562 - RNA, 21 nt, Homo sapiens
aagacccuucucagacacuau

SEQ ID NO: 5563 - RNA, 21 nt, Homo sapiens
agacccuucucagacacuauc

SEQ ID NO: 5564 - RNA, 21 nt, Homo sapiens
gacccuucucagacacuauca

SEQ ID NO: 5565 - RNA, 21 nt, Homo sapiens
acccuucucagacacuaucau

SEQ ID NO: 5566 - RNA, 21 nt, Homo sapiens
cccuucucagacacuaucauu

SEQ ID NO: 5567 - RNA, 21 nt, Homo sapiens
ccuucucagacacuaucauuu

SEQ ID NO: 5568 - RNA, 21 nt, Homo sapiens
cuucucagacacuaucauuuu

SEQ ID NO: 5569 - RNA, 21 nt, Homo sapiens
uucucagacacuaucauuuug

SEQ ID NO: 5570 - RNA, 21 nt, Homo sapiens
ucucagacacuaucauuuugu

SEQ ID NO: 5571 - RNA, 21 nt, Homo sapiens
cucagacacuaucauuuugug

SEQ ID NO: 5572 - RNA, 21 nt, Homo sapiens
ucagacacuaucauuuugugc

SEQ ID NO: 5573 - RNA, 21 nt, Homo sapiens
cagacacuaucauuuugugca

SEQ ID NO: 5574 - RNA, 21 nt, Homo sapiens
agacacuaucauuuugugcaa

SEQ ID NO: 5575 - RNA, 21 nt, Homo sapiens
gacacuaucauuuugugcaaa

SEQ ID NO: 5576 - RNA, 21 nt, Homo sapiens
acacuaucauuuugugcaaau

SEQ ID NO: 5577 - RNA, 21 nt, Homo sapiens
cacuaucauuuugugcaaauc

SEQ ID NO: 5578 - RNA, 21 nt, Homo sapiens
acuaucauuuugugcaaauca

SEQ ID NO: 5579 - RNA, 21 nt, Homo sapiens
cuaucauuuugugcaaaucau

SEQ ID NO: 5580 - RNA, 21 nt, Homo sapiens
uaucauuuugugcaaaucauc

SEQ ID NO: 5581 - RNA, 21 nt, Homo sapiens
aucauuuugugcaaaucaucu

SEQ ID NO: 5582 - RNA, 21 nt, Homo sapiens
ucauuuugugcaaaucaucug

SEQ ID NO: 5583 - RNA, 21 nt, Homo sapiens
cauuuugugcaaaucaucuga

SEQ ID NO: 5584 - RNA, 21 nt, Homo sapiens
auuuugugcaaaucaucugau

SEQ ID NO: 5585 - RNA, 21 nt, Homo sapiens
uuuugugcaaaucaucugauu

SEQ ID NO: 5586 - RNA, 21 nt, Homo sapiens
uuugugcaaaucaucugauug

SEQ ID NO: 5587 - RNA, 21 nt, Homo sapiens
uugugcaaaucaucugauuga

SEQ ID NO: 5588 - RNA, 21 nt, Homo sapiens
ugugcaaaucaucugauugaa

SEQ ID NO: 5589 - RNA, 21 nt, Homo sapiens
gugcaaaucaucugauugaac

SEQ ID NO: 5590 - RNA, 21 nt, Homo sapiens
ugcaaaucaucugauugaacu

SEQ ID NO: 5591 - RNA, 21 nt, Homo sapiens
gcaaaucaucugauugaacug

SEQ ID NO: 5592 - RNA, 21 nt, Homo sapiens
caaaucaucugauugaacugu

SEQ ID NO: 5593 - RNA, 21 nt, Homo sapiens
aaaucaucugauugaacuguu

SEQ ID NO: 5594 - RNA, 21 nt, Homo sapiens
aaucaucugauugaacuguuc

SEQ ID NO: 5595 - RNA, 21 nt, Homo sapiens
aucaucugauugaacuguucu

SEQ ID NO: 5596 - RNA, 21 nt, Homo sapiens
ucaucugauugaacuguucuu

SEQ ID NO: 5597 - RNA, 21 nt, Homo sapiens
caucugauugaacuguucuuc

SEQ ID NO: 5598 - RNA, 21 nt, Homo sapiens
aucugauugaacuguucuucc

SEQ ID NO: 5599 - RNA, 21 nt, Homo sapiens
ucugauugaacuguucuucca

SEQ ID NO: 5600 - RNA, 21 nt, Homo sapiens
cugauugaacuguucuuccau

SEQ ID NO: 5601 - RNA, 21 nt, Homo sapiens
ugauugaacuguucuuccauu

SEQ ID NO: 5602 - RNA, 21 nt, Homo sapiens
gauugaacuguucuuccauuu

SEQ ID NO: 5603 - RNA, 21 nt, Homo sapiens
auugaacuguucuuccauuua

SEQ ID NO: 5604 - RNA, 21 nt, Homo sapiens
uugaacuguucuuccauuuag

SEQ ID NO: 5605 - RNA, 21 nt, Homo sapiens
ugaacuguucuuccauuuaga

SEQ ID NO: 5606 - RNA, 21 nt, Homo sapiens
gaacuguucuuccauuuagau

SEQ ID NO: 5607 - RNA, 21 nt, Homo sapiens
aacuguucuuccauuuagaua

SEQ ID NO: 5608 - RNA, 21 nt, Homo sapiens
acuguucuuccauuuagauac

SEQ ID NO: 5609 - RNA, 21 nt, Homo sapiens
cuguucuuccauuuagauacc

SEQ ID NO: 5610 - RNA, 21 nt, Homo sapiens
uguucuuccauuuagauacca

SEQ ID NO: 5611 - RNA, 21 nt, Homo sapiens
guucuuccauuuagauaccau

SEQ ID NO: 5612 - RNA, 21 nt, Homo sapiens
uucuuccauuuagauaccaug

SEQ ID NO: 5613 - RNA, 21 nt, Homo sapiens
ucuuccauuuagauaccauga

SEQ ID NO: 5614 - RNA, 21 nt, Homo sapiens
cuuccauuuagauaccaugac

SEQ ID NO: 5615 - RNA, 21 nt, Homo sapiens
uuccauuuagauaccaugaca

SEQ ID NO: 5616 - RNA, 21 nt, Homo sapiens
uccauuuagauaccaugacac

SEQ ID NO: 5617 - RNA, 21 nt, Homo sapiens
ccauuuagauaccaugacaca

SEQ ID NO: 5618 - RNA, 21 nt, Homo sapiens
cauuuagauaccaugacacau

SEQ ID NO: 5619 - RNA, 21 nt, Homo sapiens
auuuagauaccaugacacauc

SEQ ID NO: 5620 - RNA, 21 nt, Homo sapiens
uuuagauaccaugacacauca

SEQ ID NO: 5621 - RNA, 21 nt, Homo sapiens
uuagauaccaugacacaucag

SEQ ID NO: 5622 - RNA, 21 nt, Homo sapiens
uagauaccaugacacaucagg

SEQ ID NO: 5623 - RNA, 21 nt, Homo sapiens
agauaccaugacacaucagga

SEQ ID NO: 5624 - RNA, 21 nt, Homo sapiens
gauaccaugacacaucaggag

SEQ ID NO: 5625 - RNA, 21 nt, Homo sapiens
auaccaugacacaucaggagc

SEQ ID NO: 5626 - RNA, 21 nt, Homo sapiens
uaccaugacacaucaggagcu

SEQ ID NO: 5627 - RNA, 21 nt, Homo sapiens
accaugacacaucaggagcug

SEQ ID NO: 5628 - RNA, 21 nt, Homo sapiens
ccaugacacaucaggagcugg

SEQ ID NO: 5629 - RNA, 21 nt, Homo sapiens
caugacacaucaggagcuggc

SEQ ID NO: 5630 - RNA, 21 nt, Homo sapiens
augacacaucaggagcuggca

SEQ ID NO: 5631 - RNA, 21 nt, Homo sapiens
ugacacaucaggagcuggcag

SEQ ID NO: 5632 - RNA, 21 nt, Homo sapiens
gacacaucaggagcuggcagu

SEQ ID NO: 5633 - RNA, 21 nt, Homo sapiens
acacaucaggagcuggcaguc

SEQ ID NO: 5634 - RNA, 21 nt, Homo sapiens
cacaucaggagcuggcagucc

SEQ ID NO: 5635 - RNA, 21 nt, Homo sapiens
acaucaggagcuggcagucca

SEQ ID NO: 5636 - RNA, 21 nt, Homo sapiens
caucaggagcuggcaguccac

SEQ ID NO: 5637 - RNA, 21 nt, Homo sapiens
aucaggagcuggcaguccacu

SEQ ID NO: 5638 - RNA, 21 nt, Homo sapiens
ucaggagcuggcaguccacuc

SEQ ID NO: 5639 - RNA, 21 nt, Homo sapiens
caggagcuggcaguccacuca

SEQ ID NO: 5640 - RNA, 21 nt, Homo sapiens
aggagcuggcaguccacucac

SEQ ID NO: 5641 - RNA, 21 nt, Homo sapiens
ggagcuggcaguccacucacu

SEQ ID NO: 5642 - RNA, 21 nt, Homo sapiens
gagcuggcaguccacucacuu

SEQ ID NO: 5643 - RNA, 21 nt, Homo sapiens
agcuggcaguccacucacuuu

SEQ ID NO: 5644 - RNA, 21 nt, Homo sapiens
gcuggcaguccacucacuuug

SEQ ID NO: 5645 - RNA, 21 nt, Homo sapiens
cuggcaguccacucacuuuga

SEQ ID NO: 5646 - RNA, 21 nt, Homo sapiens
uggcaguccacucacuuugaa

SEQ ID NO: 5647 - RNA, 21 nt, Homo sapiens
ggcaguccacucacuuugaag

SEQ ID NO: 5648 - RNA, 21 nt, Homo sapiens
gcaguccacucacuuugaagu

SEQ ID NO: 5649 - RNA, 21 nt, Homo sapiens
caguccacucacuuugaaguc

SEQ ID NO: 5650 - RNA, 21 nt, Homo sapiens
aguccacucacuuugaagucc

SEQ ID NO: 5651 - RNA, 21 nt, Homo sapiens
guccacucacuuugaagucca

SEQ ID NO: 5652 - RNA, 21 nt, Homo sapiens
uccacucacuuugaaguccau

SEQ ID NO: 5653 - RNA, 21 nt, Homo sapiens
ccacucacuuugaaguccauu

SEQ ID NO: 5654 - RNA, 21 nt, Homo sapiens
cacucacuuugaaguccauuc

SEQ ID NO: 5655 - RNA, 21 nt, Homo sapiens
acucacuuugaaguccauucu

SEQ ID NO: 5656 - RNA, 21 nt, Homo sapiens
cucacuuugaaguccauucug

SEQ ID NO: 5657 - RNA, 21 nt, Homo sapiens
ucacuuugaaguccauucugc

SEQ ID NO: 5658 - RNA, 21 nt, Homo sapiens
cacuuugaaguccauucugca

SEQ ID NO: 5659 - RNA, 21 nt, Homo sapiens
acuuugaaguccauucugcag

SEQ ID NO: 5660 - RNA, 21 nt, Homo sapiens
cuuugaaguccauucugcaga

SEQ ID NO: 5661 - RNA, 21 nt, Homo sapiens
uuugaaguccauucugcagaa

SEQ ID NO: 5662 - RNA, 21 nt, Homo sapiens
uugaaguccauucugcagaau

SEQ ID NO: 5663 - RNA, 21 nt, Homo sapiens
ugaaguccauucugcagaauc

SEQ ID NO: 5664 - RNA, 21 nt, Homo sapiens
gaaguccauucugcagaaucu

SEQ ID NO: 5665 - RNA, 21 nt, Homo sapiens
aaguccauucugcagaaucuu

SEQ ID NO: 5666 - RNA, 21 nt, Homo sapiens
aguccauucugcagaaucuuc

SEQ ID NO: 5667 - RNA, 21 nt, Homo sapiens
guccauucugcagaaucuucc

SEQ ID NO: 5668 - RNA, 21 nt, Homo sapiens
uccauucugcagaaucuuccu

SEQ ID NO: 5669 - RNA, 21 nt, Homo sapiens
ccauucugcagaaucuuccuu

SEQ ID NO: 5670 - RNA, 21 nt, Homo sapiens
cauucugcagaaucuuccuuc

SEQ ID NO: 5671 - RNA, 21 nt, Homo sapiens
auucugcagaaucuuccuuca

SEQ ID NO: 5672 - RNA, 21 nt, Homo sapiens
uucugcagaaucuuccuucau

SEQ ID NO: 5673 - RNA, 21 nt, Homo sapiens
ucugcagaaucuuccuucauc

SEQ ID NO: 5674 - RNA, 21 nt, Homo sapiens
cugcagaaucuuccuucauca

SEQ ID NO: 5675 - RNA, 21 nt, Homo sapiens
ugcagaaucuuccuucaucaa

SEQ ID NO: 5676 - RNA, 21 nt, Homo sapiens
gcagaaucuuccuucaucaau

SEQ ID NO: 5677 - RNA, 21 nt, Homo sapiens
cagaaucuuccuucaucaauc

SEQ ID NO: 5678 - RNA, 21 nt, Homo sapiens
agaaucuuccuucaucaaucg

SEQ ID NO: 5679 - RNA, 21 nt, Homo sapiens
gaaucuuccuucaucaaucga

SEQ ID NO: 5680 - RNA, 21 nt, Homo sapiens
aaucuuccuucaucaaucgac

SEQ ID NO: 5681 - RNA, 21 nt, Homo sapiens
aucuuccuucaucaaucgaca

SEQ ID NO: 5682 - RNA, 21 nt, Homo sapiens
ucuuccuucaucaaucgacau

SEQ ID NO: 5683 - RNA, 21 nt, Homo sapiens
cuuccuucaucaaucgacaug

SEQ ID NO: 5684 - RNA, 21 nt, Homo sapiens
uuccuucaucaaucgacaugu

SEQ ID NO: 5685 - RNA, 21 nt, Homo sapiens
uccuucaucaaucgacauguu

SEQ ID NO: 5686 - RNA, 21 nt, Homo sapiens
ccuucaucaaucgacauguuc

SEQ ID NO: 5687 - RNA, 21 nt, Homo sapiens
cuucaucaaucgacauguucu

SEQ ID NO: 5688 - RNA, 21 nt, Homo sapiens
uucaucaaucgacauguucuc

SEQ ID NO: 5689 - RNA, 21 nt, Homo sapiens
ucaucaaucgacauguucucu

SEQ ID NO: 5690 - RNA, 21 nt, Homo sapiens
caucaaucgacauguucucug

SEQ ID NO: 5691 - RNA, 21 nt, Homo sapiens
aucaaucgacauguucucugg

SEQ ID NO: 5692 - RNA, 21 nt, Homo sapiens
ucaaucgacauguucucuggc

SEQ ID NO: 5693 - RNA, 21 nt, Homo sapiens
caaucgacauguucucuggca

SEQ ID NO: 5694 - RNA, 21 nt, Homo sapiens
aaucgacauguucucuggcac

SEQ ID NO: 5695 - RNA, 21 nt, Homo sapiens
aucgacauguucucuggcacu

SEQ ID NO: 5696 - RNA, 21 nt, Homo sapiens
ucgacauguucucuggcacuu

SEQ ID NO: 5697 - RNA, 21 nt, Homo sapiens
cgacauguucucuggcacuug

SEQ ID NO: 5698 - RNA, 21 nt, Homo sapiens
gacauguucucuggcacuuga

SEQ ID NO: 5699 - RNA, 21 nt, Homo sapiens
acauguucucuggcacuugaa

SEQ ID NO: 5700 - RNA, 21 nt, Homo sapiens
cauguucucuggcacuugaau

SEQ ID NO: 5701 - RNA, 21 nt, Homo sapiens
auguucucuggcacuugaaug

SEQ ID NO: 5702 - RNA, 21 nt, Homo sapiens
uguucucuggcacuugaauga

SEQ ID NO: 5703 - RNA, 21 nt, Homo sapiens
guucucuggcacuugaaugaa

SEQ ID NO: 5704 - RNA, 21 nt, Homo sapiens
uucucuggcacuugaaugaaa

SEQ ID NO: 5705 - RNA, 21 nt, Homo sapiens
ucucuggcacuugaaugaaac

SEQ ID NO: 5706 - RNA, 21 nt, Homo sapiens
cucuggcacuugaaugaaacg

SEQ ID NO: 5707 - RNA, 21 nt, Homo sapiens
ucuggcacuugaaugaaacgu

SEQ ID NO: 5708 - RNA, 21 nt, Homo sapiens
cuggcacuugaaugaaacgug

SEQ ID NO: 5709 - RNA, 21 nt, Homo sapiens
uggcacuugaaugaaacgugg

SEQ ID NO: 5710 - RNA, 21 nt, Homo sapiens
ggcacuugaaugaaacguggu

SEQ ID NO: 5711 - RNA, 21 nt, Homo sapiens
gcacuugaaugaaacguggug

SEQ ID NO: 5712 - RNA, 21 nt, Homo sapiens
cacuugaaugaaacguggugg

SEQ ID NO: 5713 - RNA, 21 nt, Homo sapiens
acuugaaugaaacgugguggg

SEQ ID NO: 5714 - RNA, 21 nt, Homo sapiens
cuugaaugaaacguggugggu

SEQ ID NO: 5715 - RNA, 21 nt, Homo sapiens
uugaaugaaacguggugggua

SEQ ID NO: 5716 - RNA, 21 nt, Homo sapiens
ugaaugaaacgugguggguaa

SEQ ID NO: 5717 - RNA, 21 nt, Homo sapiens
gaaugaaacgugguggguaaa

SEQ ID NO: 5718 - RNA, 21 nt, Homo sapiens
aaugaaacgugguggguaaaa

SEQ ID NO: 5719 - RNA, 21 nt, Homo sapiens
augaaacgugguggguaaaau

SEQ ID NO: 5720 - RNA, 21 nt, Homo sapiens
ugaaacgugguggguaaaauu

SEQ ID NO: 5721 - RNA, 21 nt, Homo sapiens
gaaacgugguggguaaaauuu

SEQ ID NO: 5722 - RNA, 21 nt, Homo sapiens
aaacgugguggguaaaauuuc

SEQ ID NO: 5723 - RNA, 21 nt, Homo sapiens
aacgugguggguaaaauuucu

SEQ ID NO: 5724 - RNA, 21 nt, Homo sapiens
acgugguggguaaaauuucuc

SEQ ID NO: 5725 - RNA, 21 nt, Homo sapiens
cgugguggguaaaauuucucc

SEQ ID NO: 5726 - RNA, 21 nt, Homo sapiens
gugguggguaaaauuucuccu

SEQ ID NO: 5727 - RNA, 21 nt, Homo sapiens
ugguggguaaaauuucuccug

SEQ ID NO: 5728 - RNA, 21 nt, Homo sapiens
gguggguaaaauuucuccugg

SEQ ID NO: 5729 - RNA, 21 nt, Homo sapiens
guggguaaaauuucuccugga

SEQ ID NO: 5730 - RNA, 21 nt, Homo sapiens
uggguaaaauuucuccuggau

SEQ ID NO: 5731 - RNA, 21 nt, Homo sapiens
ggguaaaauuucuccuggauu

SEQ ID NO: 5732 - RNA, 21 nt, Homo sapiens
gguaaaauuucuccuggauug

SEQ ID NO: 5733 - RNA, 21 nt, Homo sapiens
guaaaauuucuccuggauugc

SEQ ID NO: 5734 - RNA, 21 nt, Homo sapiens
uaaaauuucuccuggauugca

SEQ ID NO: 5735 - RNA, 21 nt, Homo sapiens
aaaauuucuccuggauugcau

SEQ ID NO: 5736 - RNA, 21 nt, Homo sapiens
aaauuucuccuggauugcauc

SEQ ID NO: 5737 - RNA, 21 nt, Homo sapiens
aauuucuccuggauugcaucc

SEQ ID NO: 5738 - RNA, 21 nt, Homo sapiens
auuucuccuggauugcauccu

SEQ ID NO: 5739 - RNA, 21 nt, Homo sapiens
uuucuccuggauugcauccug

SEQ ID NO: 5740 - RNA, 21 nt, Homo sapiens
uucuccuggauugcauccuga

SEQ ID NO: 5741 - RNA, 21 nt, Homo sapiens
ucuccuggauugcauccugau

SEQ ID NO: 5742 - RNA, 21 nt, Homo sapiens
cuccuggauugcauccugauc

SEQ ID NO: 5743 - RNA, 21 nt, Homo sapiens
uccuggauugcauccugauca

SEQ ID NO: 5744 - RNA, 21 nt, Homo sapiens
ccuggauugcauccugaucau

SEQ ID NO: 5745 - RNA, 21 nt, Homo sapiens
cuggauugcauccugaucauu

SEQ ID NO: 5746 - RNA, 21 nt, Homo sapiens
uggauugcauccugaucauuc

SEQ ID NO: 5747 - RNA, 21 nt, Homo sapiens
ggauugcauccugaucauuca

SEQ ID NO: 5748 - RNA, 21 nt, Homo sapiens
gauugcauccugaucauucac

SEQ ID NO: 5749 - RNA, 21 nt, Homo sapiens
auugcauccugaucauucaca

SEQ ID NO: 5750 - RNA, 21 nt, Homo sapiens
uugcauccugaucauucacau

SEQ ID NO: 5751 - RNA, 21 nt, Homo sapiens
ugcauccugaucauucacauc

SEQ ID NO: 5752 - RNA, 21 nt, Homo sapiens
gcauccugaucauucacaucu

SEQ ID NO: 5753 - RNA, 21 nt, Homo sapiens
cauccugaucauucacaucuc

SEQ ID NO: 5754 - RNA, 21 nt, Homo sapiens
auccugaucauucacaucucc

SEQ ID NO: 5755 - RNA, 21 nt, Homo sapiens
uccugaucauucacaucuccc

SEQ ID NO: 5756 - RNA, 21 nt, Homo sapiens
ccugaucauucacaucucccc

SEQ ID NO: 5757 - RNA, 21 nt, Homo sapiens
cugaucauucacaucuccccu

SEQ ID NO: 5758 - RNA, 21 nt, Homo sapiens
ugaucauucacaucuccccuu

SEQ ID NO: 5759 - RNA, 21 nt, Homo sapiens
gaucauucacaucuccccuug

SEQ ID NO: 5760 - RNA, 21 nt, Homo sapiens
aucauucacaucuccccuuga

SEQ ID NO: 5761 - RNA, 21 nt, Homo sapiens
ucauucacaucuccccuugag

SEQ ID NO: 5762 - RNA, 21 nt, Homo sapiens
cauucacaucuccccuugagg

SEQ ID NO: 5763 - RNA, 21 nt, Homo sapiens
auucacaucuccccuugaggu

SEQ ID NO: 5764 - RNA, 21 nt, Homo sapiens
uucacaucuccccuugagguu

SEQ ID NO: 5765 - RNA, 21 nt, Homo sapiens
ucacaucuccccuugagguug

SEQ ID NO: 5766 - RNA, 21 nt, Homo sapiens
cacaucuccccuugagguuga

SEQ ID NO: 5767 - RNA, 21 nt, Homo sapiens
acaucuccccuugagguugau

SEQ ID NO: 5768 - RNA, 21 nt, Homo sapiens
caucuccccuugagguugauc

SEQ ID NO: 5769 - RNA, 21 nt, Homo sapiens
aucuccccuugagguugaucu

SEQ ID NO: 5770 - RNA, 21 nt, Homo sapiens
ucuccccuugagguugaucua

SEQ ID NO: 5771 - RNA, 21 nt, Homo sapiens
cuccccuugagguugaucuac

SEQ ID NO: 5772 - RNA, 21 nt, Homo sapiens
uccccuugagguugaucuacu

SEQ ID NO: 5773 - RNA, 21 nt, Homo sapiens
ccccuugagguugaucuacuu

SEQ ID NO: 5774 - RNA, 21 nt, Homo sapiens
cccuugagguugaucuacuuc

SEQ ID NO: 5775 - RNA, 21 nt, Homo sapiens
ccuugagguugaucuacuucu

SEQ ID NO: 5776 - RNA, 21 nt, Homo sapiens
cuugagguugaucuacuucuu

SEQ ID NO: 5777 - RNA, 21 nt, Homo sapiens
uugagguugaucuacuucuua

SEQ ID NO: 5778 - RNA, 21 nt, Homo sapiens
ugagguugaucuacuucuuac

SEQ ID NO: 5779 - RNA, 21 nt, Homo sapiens
gagguugaucuacuucuuacu

SEQ ID NO: 5780 - RNA, 21 nt, Homo sapiens
agguugaucuacuucuuacuu

SEQ ID NO: 5781 - RNA, 21 nt, Homo sapiens
gguugaucuacuucuuacuug

SEQ ID NO: 5782 - RNA, 21 nt, Homo sapiens
guugaucuacuucuuacuugu

SEQ ID NO: 5783 - RNA, 21 nt, Homo sapiens
uugaucuacuucuuacuugug

SEQ ID NO: 5784 - RNA, 21 nt, Homo sapiens
ugaucuacuucuuacuuguga

SEQ ID NO: 5785 - RNA, 21 nt, Homo sapiens
gaucuacuucuuacuugugau

SEQ ID NO: 5786 - RNA, 21 nt, Homo sapiens
aucuacuucuuacuugugaug

SEQ ID NO: 5787 - RNA, 21 nt, Homo sapiens
ucuacuucuuacuugugaugu

SEQ ID NO: 5788 - RNA, 21 nt, Homo sapiens
cuacuucuuacuugugaugua

SEQ ID NO: 5789 - RNA, 21 nt, Homo sapiens
uacuucuuacuugugauguag

SEQ ID NO: 5790 - RNA, 21 nt, Homo sapiens
acuucuuacuugugauguagg

SEQ ID NO: 5791 - RNA, 21 nt, Homo sapiens
cuucuuacuugugauguagga

SEQ ID NO: 5792 - RNA, 21 nt, Homo sapiens
uucuuacuugugauguaggaa

SEQ ID NO: 5793 - RNA, 21 nt, Homo sapiens
ucuuacuugugauguaggaac

SEQ ID NO: 5794 - RNA, 21 nt, Homo sapiens
cuuacuugugauguaggaacu

SEQ ID NO: 5795 - RNA, 21 nt, Homo sapiens
uuacuugugauguaggaacuu

SEQ ID NO: 5796 - RNA, 21 nt, Homo sapiens
uacuugugauguaggaacuug

SEQ ID NO: 5797 - RNA, 21 nt, Homo sapiens
acuugugauguaggaacuugc

SEQ ID NO: 5798 - RNA, 21 nt, Homo sapiens
cuugugauguaggaacuugca

SEQ ID NO: 5799 - RNA, 21 nt, Homo sapiens
uugugauguaggaacuugcag

SEQ ID NO: 5800 - RNA, 21 nt, Homo sapiens
ugugauguaggaacuugcagu

SEQ ID NO: 5801 - RNA, 21 nt, Homo sapiens
gugauguaggaacuugcaguc

SEQ ID NO: 5802 - RNA, 21 nt, Homo sapiens
ugauguaggaacuugcagucg

SEQ ID NO: 5803 - RNA, 21 nt, Homo sapiens
gauguaggaacuugcagucgc

SEQ ID NO: 5804 - RNA, 21 nt, Homo sapiens
auguaggaacuugcagucgcg

SEQ ID NO: 5805 - RNA, 21 nt, Homo sapiens
uguaggaacuugcagucgcgc

SEQ ID NO: 5806 - RNA, 21 nt, Homo sapiens
guaggaacuugcagucgcgca

SEQ ID NO: 5807 - RNA, 21 nt, Homo sapiens
uaggaacuugcagucgcgcau

SEQ ID NO: 5808 - RNA, 21 nt, Homo sapiens
aggaacuugcagucgcgcaug

SEQ ID NO: 5809 - RNA, 21 nt, Homo sapiens
ggaacuugcagucgcgcaugu

SEQ ID NO: 5810 - RNA, 21 nt, Homo sapiens
gaacuugcagucgcgcauguu

SEQ ID NO: 5811 - RNA, 21 nt, Homo sapiens
aacuugcagucgcgcauguuc

SEQ ID NO: 5812 - RNA, 21 nt, Homo sapiens
acuugcagucgcgcauguucu

SEQ ID NO: 5813 - RNA, 21 nt, Homo sapiens
cuugcagucgcgcauguucug

SEQ ID NO: 5814 - RNA, 21 nt, Homo sapiens
uugcagucgcgcauguucuga

SEQ ID NO: 5815 - RNA, 21 nt, Homo sapiens
ugcagucgcgcauguucugag

SEQ ID NO: 5816 - RNA, 21 nt, Homo sapiens
gcagucgcgcauguucugagu

SEQ ID NO: 5817 - RNA, 21 nt, Homo sapiens
cagucgcgcauguucugaguu

SEQ ID NO: 5818 - RNA, 21 nt, Homo sapiens
agucgcgcauguucugaguug

SEQ ID NO: 5819 - RNA, 21 nt, Homo sapiens
gucgcgcauguucugaguugu

SEQ ID NO: 5820 - RNA, 21 nt, Homo sapiens
ucgcgcauguucugaguugug

SEQ ID NO: 5821 - RNA, 21 nt, Homo sapiens
cgcgcauguucugaguugugu

SEQ ID NO: 5822 - RNA, 21 nt, Homo sapiens
gcgcauguucugaguuguguu

SEQ ID NO: 5823 - RNA, 21 nt, Homo sapiens
cgcauguucugaguuguguug

SEQ ID NO: 5824 - RNA, 21 nt, Homo sapiens
gcauguucugaguuguguugc

SEQ ID NO: 5825 - RNA, 21 nt, Homo sapiens
cauguucugaguuguguugcu

SEQ ID NO: 5826 - RNA, 21 nt, Homo sapiens
auguucugaguuguguugcug

SEQ ID NO: 5827 - RNA, 21 nt, Homo sapiens
uguucugaguuguguugcugc

SEQ ID NO: 5828 - RNA, 21 nt, Homo sapiens
guucugaguuguguugcugcg

SEQ ID NO: 5829 - RNA, 21 nt, Homo sapiens
uucugaguuguguugcugcga

SEQ ID NO: 5830 - RNA, 21 nt, Homo sapiens
ucugaguuguguugcugcgag

SEQ ID NO: 5831 - RNA, 21 nt, Homo sapiens
cugaguuguguugcugcgagu

SEQ ID NO: 5832 - RNA, 21 nt, Homo sapiens
ugaguuguguugcugcgaguc

SEQ ID NO: 5833 - RNA, 21 nt, Homo sapiens
gaguuguguugcugcgagucu

SEQ ID NO: 5834 - RNA, 21 nt, Homo sapiens
aguuguguugcugcgagucuu

SEQ ID NO: 5835 - RNA, 21 nt, Homo sapiens
guuguguugcugcgagucuug

SEQ ID NO: 5836 - RNA, 21 nt, Homo sapiens
uuguguugcugcgagucuugu

SEQ ID NO: 5837 - RNA, 21 nt, Homo sapiens
uguguugcugcgagucuugug

SEQ ID NO: 5838 - RNA, 21 nt, Homo sapiens
guguugcugcgagucuugugc

SEQ ID NO: 5839 - RNA, 21 nt, Homo sapiens
uguugcugcgagucuugugca

SEQ ID NO: 5840 - RNA, 21 nt, Homo sapiens
guugcugcgagucuugugcac

SEQ ID NO: 5841 - RNA, 21 nt, Homo sapiens
uugcugcgagucuugugcacc

SEQ ID NO: 5842 - RNA, 21 nt, Homo sapiens
ugcugcgagucuugugcacca

SEQ ID NO: 5843 - RNA, 21 nt, Homo sapiens
gcugcgagucuugugcaccac

SEQ ID NO: 5844 - RNA, 21 nt, Homo sapiens
cugcgagucuugugcaccacu

SEQ ID NO: 5845 - RNA, 21 nt, Homo sapiens
ugcgagucuugugcaccacug

SEQ ID NO: 5846 - RNA, 21 nt, Homo sapiens
gcgagucuugugcaccacugu

SEQ ID NO: 5847 - RNA, 21 nt, Homo sapiens
cgagucuugugcaccacuguc

SEQ ID NO: 5848 - RNA, 21 nt, Homo sapiens
gagucuugugcaccacuguca

SEQ ID NO: 5849 - RNA, 21 nt, Homo sapiens
agucuugugcaccacugucau

SEQ ID NO: 5850 - RNA, 21 nt, Homo sapiens
gucuugugcaccacugucauc

SEQ ID NO: 5851 - RNA, 21 nt, Homo sapiens
ucuugugcaccacugucaucc

SEQ ID NO: 5852 - RNA, 21 nt, Homo sapiens
cuugugcaccacugucauccu

SEQ ID NO: 5853 - RNA, 21 nt, Homo sapiens
uugugcaccacugucauccug

SEQ ID NO: 5854 - RNA, 21 nt, Homo sapiens
ugugcaccacugucauccuga

SEQ ID NO: 5855 - RNA, 21 nt, Homo sapiens
gugcaccacugucauccugag

SEQ ID NO: 5856 - RNA, 21 nt, Homo sapiens
ugcaccacugucauccugagc

SEQ ID NO: 5857 - RNA, 21 nt, Homo sapiens
gcaccacugucauccugagcu

SEQ ID NO: 5858 - RNA, 21 nt, Homo sapiens
caccacugucauccugagcuu

SEQ ID NO: 5859 - RNA, 21 nt, Homo sapiens
accacugucauccugagcuug

SEQ ID NO: 5860 - RNA, 21 nt, Homo sapiens
ccacugucauccugagcuuga

SEQ ID NO: 5861 - RNA, 21 nt, Homo sapiens
cacugucauccugagcuugaa

SEQ ID NO: 5862 - RNA, 21 nt, Homo sapiens
acugucauccugagcuugaaa

SEQ ID NO: 5863 - RNA, 21 nt, Homo sapiens
cugucauccugagcuugaaac

SEQ ID NO: 5864 - RNA, 21 nt, Homo sapiens
ugucauccugagcuugaaaca

SEQ ID NO: 5865 - RNA, 21 nt, Homo sapiens
gucauccugagcuugaaacac

SEQ ID NO: 5866 - RNA, 21 nt, Homo sapiens
ucauccugagcuugaaacaca

SEQ ID NO: 5867 - RNA, 21 nt, Homo sapiens
cauccugagcuugaaacacag

SEQ ID NO: 5868 - RNA, 21 nt, Homo sapiens
auccugagcuugaaacacagc

SEQ ID NO: 5869 - RNA, 21 nt, Homo sapiens
uccugagcuugaaacacagca

SEQ ID NO: 5870 - RNA, 21 nt, Homo sapiens
ccugagcuugaaacacagcag

SEQ ID NO: 5871 - RNA, 21 nt, Homo sapiens
cugagcuugaaacacagcagc

SEQ ID NO: 5872 - RNA, 21 nt, Homo sapiens
ugagcuugaaacacagcagcu

SEQ ID NO: 5873 - RNA, 21 nt, Homo sapiens
gagcuugaaacacagcagcug

SEQ ID NO: 5874 - RNA, 21 nt, Homo sapiens
agcuugaaacacagcagcugc

SEQ ID NO: 5875 - RNA, 21 nt, Homo sapiens
gcuugaaacacagcagcugca

SEQ ID NO: 5876 - RNA, 21 nt, Homo sapiens
cuugaaacacagcagcugcau

SEQ ID NO: 5877 - RNA, 21 nt, Homo sapiens
uugaaacacagcagcugcauu

SEQ ID NO: 5878 - RNA, 21 nt, Homo sapiens
ugaaacacagcagcugcauuc

SEQ ID NO: 5879 - RNA, 21 nt, Homo sapiens
gaaacacagcagcugcauucu

SEQ ID NO: 5880 - RNA, 21 nt, Homo sapiens
aaacacagcagcugcauucug

SEQ ID NO: 5881 - RNA, 21 nt, Homo sapiens
aacacagcagcugcauucugu

SEQ ID NO: 5882 - RNA, 21 nt, Homo sapiens
acacagcagcugcauucugug

SEQ ID NO: 5883 - RNA, 21 nt, Homo sapiens
cacagcagcugcauucugugg

SEQ ID NO: 5884 - RNA, 21 nt, Homo sapiens
acagcagcugcauucuguggu

SEQ ID NO: 5885 - RNA, 21 nt, Homo sapiens
cagcagcugcauucugugguc

SEQ ID NO: 5886 - RNA, 21 nt, Homo sapiens
agcagcugcauucuguggucc

SEQ ID NO: 5887 - RNA, 21 nt, Homo sapiens
gcagcugcauucugugguccu

SEQ ID NO: 5888 - RNA, 21 nt, Homo sapiens
cagcugcauucugugguccua

SEQ ID NO: 5889 - RNA, 21 nt, Homo sapiens
agcugcauucugugguccuag

SEQ ID NO: 5890 - RNA, 21 nt, Homo sapiens
gcugcauucugugguccuagc

SEQ ID NO: 5891 - RNA, 21 nt, Homo sapiens
cugcauucugugguccuagca

SEQ ID NO: 5892 - RNA, 21 nt, Homo sapiens
ugcauucugugguccuagcaa

SEQ ID NO: 5893 - RNA, 21 nt, Homo sapiens
gcauucugugguccuagcaau

SEQ ID NO: 5894 - RNA, 21 nt, Homo sapiens
cauucugugguccuagcaauc

SEQ ID NO: 5895 - RNA, 21 nt, Homo sapiens
auucugugguccuagcaaucu

SEQ ID NO: 5896 - RNA, 21 nt, Homo sapiens
uucugugguccuagcaaucug

SEQ ID NO: 5897 - RNA, 21 nt, Homo sapiens
ucugugguccuagcaaucugc

SEQ ID NO: 5898 - RNA, 21 nt, Homo sapiens
cugugguccuagcaaucugcg

SEQ ID NO: 5899 - RNA, 21 nt, Homo sapiens
ugugguccuagcaaucugcga

SEQ ID NO: 5900 - RNA, 21 nt, Homo sapiens
gugguccuagcaaucugcgag

SEQ ID NO: 5901 - RNA, 21 nt, Homo sapiens
ugguccuagcaaucugcgagc

SEQ ID NO: 5902 - RNA, 21 nt, Homo sapiens
gguccuagcaaucugcgagcc

SEQ ID NO: 5903 - RNA, 21 nt, Homo sapiens
guccuagcaaucugcgagcca

SEQ ID NO: 5904 - RNA, 21 nt, Homo sapiens
uccuagcaaucugcgagccau

SEQ ID NO: 5905 - RNA, 21 nt, Homo sapiens
ccuagcaaucugcgagccauc

SEQ ID NO: 5906 - RNA, 21 nt, Homo sapiens
cuagcaaucugcgagccaucu

SEQ ID NO: 5907 - RNA, 21 nt, Homo sapiens
uagcaaucugcgagccaucuu

SEQ ID NO: 5908 - RNA, 21 nt, Homo sapiens
agcaaucugcgagccaucuuc

SEQ ID NO: 5909 - RNA, 21 nt, Homo sapiens
gcaaucugcgagccaucuucu

SEQ ID NO: 5910 - RNA, 21 nt, Homo sapiens
caaucugcgagccaucuucuc

SEQ ID NO: 5911 - RNA, 21 nt, Homo sapiens
aaucugcgagccaucuucucu

SEQ ID NO: 5912 - RNA, 21 nt, Homo sapiens
aucugcgagccaucuucucuu

SEQ ID NO: 5913 - RNA, 21 nt, Homo sapiens
ucugcgagccaucuucucuuc

SEQ ID NO: 5914 - RNA, 21 nt, Homo sapiens
cugcgagccaucuucucuuca

SEQ ID NO: 5915 - RNA, 21 nt, Homo sapiens
ugcgagccaucuucucuucau

SEQ ID NO: 5916 - RNA, 21 nt, Homo sapiens
gcgagccaucuucucuucaua

SEQ ID NO: 5917 - RNA, 21 nt, Homo sapiens
cgagccaucuucucuucauau

SEQ ID NO: 5918 - RNA, 21 nt, Homo sapiens
gagccaucuucucuucauaug

SEQ ID NO: 5919 - RNA, 21 nt, Homo sapiens
agccaucuucucuucauaugu

SEQ ID NO: 5920 - RNA, 21 nt, Homo sapiens
gccaucuucucuucauauguu

SEQ ID NO: 5921 - RNA, 21 nt, Homo sapiens
ccaucuucucuucauauguua

SEQ ID NO: 5922 - RNA, 21 nt, Homo sapiens
caucuucucuucauauguuag

SEQ ID NO: 5923 - RNA, 21 nt, Homo sapiens
aucuucucuucauauguuaga

SEQ ID NO: 5924 - RNA, 21 nt, Homo sapiens
ucuucucuucauauguuagac

SEQ ID NO: 5925 - RNA, 21 nt, Homo sapiens
cuucucuucauauguuagacg

SEQ ID NO: 5926 - RNA, 21 nt, Homo sapiens
uucucuucauauguuagacgu

SEQ ID NO: 5927 - RNA, 21 nt, Homo sapiens
ucucuucauauguuagacguu

SEQ ID NO: 5928 - RNA, 21 nt, Homo sapiens
cucuucauauguuagacguug

SEQ ID NO: 5929 - RNA, 21 nt, Homo sapiens
ucuucauauguuagacguuga

SEQ ID NO: 5930 - RNA, 21 nt, Homo sapiens
cuucauauguuagacguugau

SEQ ID NO: 5931 - RNA, 21 nt, Homo sapiens
uucauauguuagacguugauu

SEQ ID NO: 5932 - RNA, 21 nt, Homo sapiens
ucauauguuagacguugauuu

SEQ ID NO: 5933 - RNA, 21 nt, Homo sapiens
cauauguuagacguugauuuc

SEQ ID NO: 5934 - RNA, 21 nt, Homo sapiens
auauguuagacguugauuucc

SEQ ID NO: 5935 - RNA, 21 nt, Homo sapiens
uauguuagacguugauuucca

SEQ ID NO: 5936 - RNA, 21 nt, Homo sapiens
auguuagacguugauuuccau

SEQ ID NO: 5937 - RNA, 21 nt, Homo sapiens
uguuagacguugauuuccauu

SEQ ID NO: 5938 - RNA, 21 nt, Homo sapiens
guuagacguugauuuccauua

SEQ ID NO: 5939 - RNA, 21 nt, Homo sapiens
uuagacguugauuuccauuau

SEQ ID NO: 5940 - RNA, 21 nt, Homo sapiens
uagacguugauuuccauuaug

SEQ ID NO: 5941 - RNA, 21 nt, Homo sapiens
agacguugauuuccauuauga

SEQ ID NO: 5942 - RNA, 21 nt, Homo sapiens
gacguugauuuccauuaugaa

SEQ ID NO: 5943 - RNA, 21 nt, Homo sapiens
acguugauuuccauuaugaag

SEQ ID NO: 5944 - RNA, 21 nt, Homo sapiens
cguugauuuccauuaugaaga

SEQ ID NO: 5945 - RNA, 21 nt, Homo sapiens
guugauuuccauuaugaagaa

SEQ ID NO: 5946 - RNA, 21 nt, Homo sapiens
uugauuuccauuaugaagaag

SEQ ID NO: 5947 - RNA, 21 nt, Homo sapiens
ugauuuccauuaugaagaagg

SEQ ID NO: 5948 - RNA, 21 nt, Homo sapiens
gauuuccauuaugaagaaggg

SEQ ID NO: 5949 - RNA, 21 nt, Homo sapiens
auuuccauuaugaagaagggu

SEQ ID NO: 5950 - RNA, 21 nt, Homo sapiens
uuuccauuaugaagaagggug

SEQ ID NO: 5951 - RNA, 21 nt, Homo sapiens
uuccauuaugaagaagggugu

SEQ ID NO: 5952 - RNA, 21 nt, Homo sapiens
uccauuaugaagaaggguguc

SEQ ID NO: 5953 - RNA, 21 nt, Homo sapiens
ccauuaugaagaagggugucc

SEQ ID NO: 5954 - RNA, 21 nt, Homo sapiens
cauuaugaagaaggguguccu

SEQ ID NO: 5955 - RNA, 21 nt, Homo sapiens
auuaugaagaaggguguccuu

SEQ ID NO: 5956 - RNA, 21 nt, Homo sapiens
uuaugaagaaggguguccuug

SEQ ID NO: 5957 - RNA, 21 nt, Homo sapiens
uaugaagaaggguguccuugc

SEQ ID NO: 5958 - RNA, 21 nt, Homo sapiens
augaagaaggguguccuugca

SEQ ID NO: 5959 - RNA, 21 nt, Homo sapiens
ugaagaaggguguccuugcau

SEQ ID NO: 5960 - RNA, 21 nt, Homo sapiens
gaagaaggguguccuugcauu

SEQ ID NO: 5961 - RNA, 21 nt, Homo sapiens
aagaaggguguccuugcauuu

SEQ ID NO: 5962 - RNA, 21 nt, Homo sapiens
agaaggguguccuugcauuuc

SEQ ID NO: 5963 - RNA, 21 nt, Homo sapiens
gaaggguguccuugcauuuca

SEQ ID NO: 5964 - RNA, 21 nt, Homo sapiens
aaggguguccuugcauuucag

SEQ ID NO: 5965 - RNA, 21 nt, Homo sapiens
aggguguccuugcauuucagc

SEQ ID NO: 5966 - RNA, 21 nt, Homo sapiens
ggguguccuugcauuucagcu

SEQ ID NO: 5967 - RNA, 21 nt, Homo sapiens
gguguccuugcauuucagcuu

SEQ ID NO: 5968 - RNA, 21 nt, Homo sapiens
guguccuugcauuucagcuuu

SEQ ID NO: 5969 - RNA, 21 nt, Homo sapiens
uguccuugcauuucagcuuuc

SEQ ID NO: 5970 - RNA, 21 nt, Homo sapiens
guccuugcauuucagcuuucu

SEQ ID NO: 5971 - RNA, 21 nt, Homo sapiens
uccuugcauuucagcuuucuu

SEQ ID NO: 5972 - RNA, 21 nt, Homo sapiens
ccuugcauuucagcuuucuuu

SEQ ID NO: 5973 - RNA, 21 nt, Homo sapiens
cuugcauuucagcuuucuuuc

SEQ ID NO: 5974 - RNA, 21 nt, Homo sapiens
uugcauuucagcuuucuuucc

SEQ ID NO: 5975 - RNA, 21 nt, Homo sapiens
ugcauuucagcuuucuuucca

SEQ ID NO: 5976 - RNA, 21 nt, Homo sapiens
gcauuucagcuuucuuuccaa

SEQ ID NO: 5977 - RNA, 21 nt, Homo sapiens
cauuucagcuuucuuuccaaa

SEQ ID NO: 5978 - RNA, 21 nt, Homo sapiens
auuucagcuuucuuuccaaau

SEQ ID NO: 5979 - RNA, 21 nt, Homo sapiens
uuucagcuuucuuuccaaauc

SEQ ID NO: 5980 - RNA, 21 nt, Homo sapiens
uucagcuuucuuuccaaaucu

SEQ ID NO: 5981 - RNA, 21 nt, Homo sapiens
ucagcuuucuuuccaaaucuu

SEQ ID NO: 5982 - RNA, 21 nt, Homo sapiens
cagcuuucuuuccaaaucuug

SEQ ID NO: 5983 - RNA, 21 nt, Homo sapiens
agcuuucuuuccaaaucuuga

SEQ ID NO: 5984 - RNA, 21 nt, Homo sapiens
gcuuucuuuccaaaucuugaa

SEQ ID NO: 5985 - RNA, 21 nt, Homo sapiens
cuuucuuuccaaaucuugaau

SEQ ID NO: 5986 - RNA, 21 nt, Homo sapiens
uuucuuuccaaaucuugaauc

SEQ ID NO: 5987 - RNA, 21 nt, Homo sapiens
uucuuuccaaaucuugaauca

SEQ ID NO: 5988 - RNA, 21 nt, Homo sapiens
ucuuuccaaaucuugaaucaa

SEQ ID NO: 5989 - RNA, 21 nt, Homo sapiens
cuuuccaaaucuugaaucaaa

SEQ ID NO: 5990 - RNA, 21 nt, Homo sapiens
uuuccaaaucuugaaucaaag

SEQ ID NO: 5991 - RNA, 21 nt, Homo sapiens
uuccaaaucuugaaucaaagc

SEQ ID NO: 5992 - RNA, 21 nt, Homo sapiens
uccaaaucuugaaucaaagcu

SEQ ID NO: 5993 - RNA, 21 nt, Homo sapiens
ccaaaucuugaaucaaagcuu

SEQ ID NO: 5994 - RNA, 21 nt, Homo sapiens
caaaucuugaaucaaagcuuc

SEQ ID NO: 5995 - RNA, 21 nt, Homo sapiens
aaaucuugaaucaaagcuucu

SEQ ID NO: 5996 - RNA, 21 nt, Homo sapiens
aaucuugaaucaaagcuucuu

SEQ ID NO: 5997 - RNA, 21 nt, Homo sapiens
aucuugaaucaaagcuucuuu

SEQ ID NO: 5998 - RNA, 21 nt, Homo sapiens
ucuugaaucaaagcuucuuuu

SEQ ID NO: 5999 - RNA, 21 nt, Homo sapiens
cuugaaucaaagcuucuuuug

SEQ ID NO: 6000 - RNA, 21 nt, Homo sapiens
uugaaucaaagcuucuuuuga

SEQ ID NO: 6001 - RNA, 21 nt, Homo sapiens
ugaaucaaagcuucuuuugau

SEQ ID NO: 6002 - RNA, 21 nt, Homo sapiens
gaaucaaagcuucuuuugauc

SEQ ID NO: 6003 - RNA, 21 nt, Homo sapiens
aaucaaagcuucuuuugaucc

SEQ ID NO: 6004 - RNA, 21 nt, Homo sapiens
aucaaagcuucuuuugauccu

SEQ ID NO: 6005 - RNA, 21 nt, Homo sapiens
ucaaagcuucuuuugauccuu

SEQ ID NO: 6006 - RNA, 21 nt, Homo sapiens
caaagcuucuuuugauccuug

SEQ ID NO: 6007 - RNA, 21 nt, Homo sapiens
aaagcuucuuuugauccuugu

SEQ ID NO: 6008 - RNA, 21 nt, Homo sapiens
aagcuucuuuugauccuugua

SEQ ID NO: 6009 - RNA, 21 nt, Homo sapiens
agcuucuuuugauccuuguau

SEQ ID NO: 6010 - RNA, 21 nt, Homo sapiens
gcuucuuuugauccuuguauu

SEQ ID NO: 6011 - RNA, 21 nt, Homo sapiens
cuucuuuugauccuuguauuu

SEQ ID NO: 6012 - RNA, 21 nt, Homo sapiens
uucuuuugauccuuguauuuc

SEQ ID NO: 6013 - RNA, 21 nt, Homo sapiens
ucuuuugauccuuguauuuca

SEQ ID NO: 6014 - RNA, 21 nt, Homo sapiens
cuuuugauccuuguauuucau

SEQ ID NO: 6015 - RNA, 21 nt, Homo sapiens
uuuugauccuuguauuucaug

SEQ ID NO: 6016 - RNA, 21 nt, Homo sapiens
uuugauccuuguauuucauga

SEQ ID NO: 6017 - RNA, 21 nt, Homo sapiens
uugauccuuguauuucaugau

SEQ ID NO: 6018 - RNA, 21 nt, Homo sapiens
ugauccuuguauuucaugauc

SEQ ID NO: 6019 - RNA, 21 nt, Homo sapiens
gauccuuguauuucaugauca

SEQ ID NO: 6020 - RNA, 21 nt, Homo sapiens
auccuuguauuucaugaucag

SEQ ID NO: 6021 - RNA, 21 nt, Homo sapiens
uccuuguauuucaugaucagg

SEQ ID NO: 6022 - RNA, 21 nt, Homo sapiens
ccuuguauuucaugaucagga

SEQ ID NO: 6023 - RNA, 21 nt, Homo sapiens
cuuguauuucaugaucaggag

SEQ ID NO: 6024 - RNA, 21 nt, Homo sapiens
uuguauuucaugaucaggagu

SEQ ID NO: 6025 - RNA, 21 nt, Homo sapiens
uguauuucaugaucaggaguu

SEQ ID NO: 6026 - RNA, 21 nt, Homo sapiens
guauuucaugaucaggaguuc

SEQ ID NO: 6027 - RNA, 21 nt, Homo sapiens
uauuucaugaucaggaguucu

SEQ ID NO: 6028 - RNA, 21 nt, Homo sapiens
auuucaugaucaggaguucuu

SEQ ID NO: 6029 - RNA, 21 nt, Homo sapiens
uuucaugaucaggaguucuug

SEQ ID NO: 6030 - RNA, 21 nt, Homo sapiens
uucaugaucaggaguucuugg

SEQ ID NO: 6031 - RNA, 21 nt, Homo sapiens
ucaugaucaggaguucuuggu

SEQ ID NO: 6032 - RNA, 21 nt, Homo sapiens
caugaucaggaguucuuggua

SEQ ID NO: 6033 - RNA, 21 nt, Homo sapiens
augaucaggaguucuugguau

SEQ ID NO: 6034 - RNA, 21 nt, Homo sapiens
ugaucaggaguucuugguaug

SEQ ID NO: 6035 - RNA, 21 nt, Homo sapiens
gaucaggaguucuugguaugg

SEQ ID NO: 6036 - RNA, 21 nt, Homo sapiens
aucaggaguucuugguauggg

SEQ ID NO: 6037 - RNA, 21 nt, Homo sapiens
ucaggaguucuugguaugggc

SEQ ID NO: 6038 - RNA, 21 nt, Homo sapiens
caggaguucuugguaugggcu

SEQ ID NO: 6039 - RNA, 21 nt, Homo sapiens
aggaguucuugguaugggcuu

SEQ ID NO: 6040 - RNA, 21 nt, Homo sapiens
ggaguucuugguaugggcuua

SEQ ID NO: 6041 - RNA, 21 nt, Homo sapiens
gaguucuugguaugggcuuag

SEQ ID NO: 6042 - RNA, 21 nt, Homo sapiens
aguucuugguaugggcuuagc

SEQ ID NO: 6043 - RNA, 21 nt, Homo sapiens
guucuugguaugggcuuagca

SEQ ID NO: 6044 - RNA, 21 nt, Homo sapiens
uucuugguaugggcuuagcau

SEQ ID NO: 6045 - RNA, 21 nt, Homo sapiens
ucuugguaugggcuuagcauu

SEQ ID NO: 6046 - RNA, 21 nt, Homo sapiens
cuugguaugggcuuagcauuu

SEQ ID NO: 6047 - RNA, 21 nt, Homo sapiens
uugguaugggcuuagcauuug

SEQ ID NO: 6048 - RNA, 21 nt, Homo sapiens
ugguaugggcuuagcauuugc

SEQ ID NO: 6049 - RNA, 21 nt, Homo sapiens
gguaugggcuuagcauuugca

SEQ ID NO: 6050 - RNA, 21 nt, Homo sapiens
guaugggcuuagcauuugcag

SEQ ID NO: 6051 - RNA, 21 nt, Homo sapiens
uaugggcuuagcauuugcagu

SEQ ID NO: 6052 - RNA, 21 nt, Homo sapiens
augggcuuagcauuugcaguu

SEQ ID NO: 6053 - RNA, 21 nt, Homo sapiens
ugggcuuagcauuugcaguuu

SEQ ID NO: 6054 - RNA, 21 nt, Homo sapiens
gggcuuagcauuugcaguuug

SEQ ID NO: 6055 - RNA, 21 nt, Homo sapiens
ggcuuagcauuugcaguuugg

SEQ ID NO: 6056 - RNA, 21 nt, Homo sapiens
gcuuagcauuugcaguuuggg

SEQ ID NO: 6057 - RNA, 21 nt, Homo sapiens
cuuagcauuugcaguuuggga

SEQ ID NO: 6058 - RNA, 21 nt, Homo sapiens
uuagcauuugcaguuugggau

SEQ ID NO: 6059 - RNA, 21 nt, Homo sapiens
uagcauuugcaguuugggaug

SEQ ID NO: 6060 - RNA, 21 nt, Homo sapiens
agcauuugcaguuugggaugg

SEQ ID NO: 6061 - RNA, 21 nt, Homo sapiens
gcauuugcaguuugggauggc

SEQ ID NO: 6062 - RNA, 21 nt, Homo sapiens
cauuugcaguuugggauggcu

SEQ ID NO: 6063 - RNA, 21 nt, Homo sapiens
auuugcaguuugggauggcuu

SEQ ID NO: 6064 - RNA, 21 nt, Homo sapiens
uuugcaguuugggauggcuuu

SEQ ID NO: 6065 - RNA, 21 nt, Homo sapiens
uugcaguuugggauggcuuug

SEQ ID NO: 6066 - RNA, 21 nt, Homo sapiens
ugcaguuugggauggcuuugc

SEQ ID NO: 6067 - RNA, 21 nt, Homo sapiens
gcaguuugggauggcuuugca

SEQ ID NO: 6068 - RNA, 21 nt, Homo sapiens
caguuugggauggcuuugcau

SEQ ID NO: 6069 - RNA, 21 nt, Homo sapiens
aguuugggauggcuuugcauu

SEQ ID NO: 6070 - RNA, 21 nt, Homo sapiens
guuugggauggcuuugcauuu

SEQ ID NO: 6071 - RNA, 21 nt, Homo sapiens
uuugggauggcuuugcauuua

SEQ ID NO: 6072 - RNA, 21 nt, Homo sapiens
uugggauggcuuugcauuuau

SEQ ID NO: 6073 - RNA, 21 nt, Homo sapiens
ugggauggcuuugcauuuaua

SEQ ID NO: 6074 - RNA, 21 nt, Homo sapiens
gggauggcuuugcauuuauag

SEQ ID NO: 6075 - RNA, 21 nt, Homo sapiens
ggauggcuuugcauuuauagg

SEQ ID NO: 6076 - RNA, 21 nt, Homo sapiens
gauggcuuugcauuuauaggu

SEQ ID NO: 6077 - RNA, 21 nt, Homo sapiens
auggcuuugcauuuauagguu

SEQ ID NO: 6078 - RNA, 21 nt, Homo sapiens
uggcuuugcauuuauagguug

SEQ ID NO: 6079 - RNA, 21 nt, Homo sapiens
ggcuuugcauuuauagguugg

SEQ ID NO: 6080 - RNA, 21 nt, Homo sapiens
gcuuugcauuuauagguuggc

SEQ ID NO: 6081 - RNA, 21 nt, Homo sapiens
cuuugcauuuauagguuggcc

SEQ ID NO: 6082 - RNA, 21 nt, Homo sapiens
uuugcauuuauagguuggcca

SEQ ID NO: 6083 - RNA, 21 nt, Homo sapiens
uugcauuuauagguuggccag

SEQ ID NO: 6084 - RNA, 21 nt, Homo sapiens
ugcauuuauagguuggccagc

SEQ ID NO: 6085 - RNA, 21 nt, Homo sapiens
gcauuuauagguuggccagcu

SEQ ID NO: 6086 - RNA, 21 nt, Homo sapiens
cauuuauagguuggccagcug

SEQ ID NO: 6087 - RNA, 21 nt, Homo sapiens
auuuauagguuggccagcuga

SEQ ID NO: 6088 - RNA, 21 nt, Homo sapiens
uuuauagguuggccagcugag

SEQ ID NO: 6089 - RNA, 21 nt, Homo sapiens
uuauagguuggccagcugagg

SEQ ID NO: 6090 - RNA, 21 nt, Homo sapiens
uauagguuggccagcugagga

SEQ ID NO: 6091 - RNA, 21 nt, Homo sapiens
auagguuggccagcugaggac

SEQ ID NO: 6092 - RNA, 21 nt, Homo sapiens
uagguuggccagcugaggacu

SEQ ID NO: 6093 - RNA, 21 nt, Homo sapiens
agguuggccagcugaggacug

SEQ ID NO: 6094 - RNA, 21 nt, Homo sapiens
gguuggccagcugaggacugu

SEQ ID NO: 6095 - RNA, 21 nt, Homo sapiens
guuggccagcugaggacuguu

SEQ ID NO: 6096 - RNA, 21 nt, Homo sapiens
uuggccagcugaggacuguug

SEQ ID NO: 6097 - RNA, 21 nt, Homo sapiens
uggccagcugaggacuguuga

SEQ ID NO: 6098 - RNA, 21 nt, Homo sapiens
ggccagcugaggacuguugau

SEQ ID NO: 6099 - RNA, 21 nt, Homo sapiens
gccagcugaggacuguugaua

SEQ ID NO: 6100 - RNA, 21 nt, Homo sapiens
ccagcugaggacuguugauag

SEQ ID NO: 6101 - RNA, 21 nt, Homo sapiens
cagcugaggacuguugauagu

SEQ ID NO: 6102 - RNA, 21 nt, Homo sapiens
agcugaggacuguugauaguu

SEQ ID NO: 6103 - RNA, 21 nt, Homo sapiens
gcugaggacuguugauaguug

SEQ ID NO: 6104 - RNA, 21 nt, Homo sapiens
cugaggacuguugauaguugg

SEQ ID NO: 6105 - RNA, 21 nt, Homo sapiens
ugaggacuguugauaguugga

SEQ ID NO: 6106 - RNA, 21 nt, Homo sapiens
gaggacuguugauaguuggaa

SEQ ID NO: 6107 - RNA, 21 nt, Homo sapiens
aggacuguugauaguuggaau

SEQ ID NO: 6108 - RNA, 21 nt, Homo sapiens
ggacuguugauaguuggaauc

SEQ ID NO: 6109 - RNA, 21 nt, Homo sapiens
gacuguugauaguuggaaucc

SEQ ID NO: 6110 - RNA, 21 nt, Homo sapiens
acuguugauaguuggaaucca

SEQ ID NO: 6111 - RNA, 21 nt, Homo sapiens
cuguugauaguuggaauccau

SEQ ID NO: 6112 - RNA, 21 nt, Homo sapiens
uguugauaguuggaauccaua

SEQ ID NO: 6113 - RNA, 21 nt, Homo sapiens
guugauaguuggaauccauag

SEQ ID NO: 6114 - RNA, 21 nt, Homo sapiens
uugauaguuggaauccauagc

SEQ ID NO: 6115 - RNA, 21 nt, Homo sapiens
ugauaguuggaauccauagcg

SEQ ID NO: 6116 - RNA, 21 nt, Homo sapiens
gauaguuggaauccauagcgg

SEQ ID NO: 6117 - RNA, 21 nt, Homo sapiens
auaguuggaauccauagcgga

SEQ ID NO: 6118 - RNA, 21 nt, Homo sapiens
uaguuggaauccauagcggaa

SEQ ID NO: 6119 - RNA, 21 nt, Homo sapiens
aguuggaauccauagcggaag

SEQ ID NO: 6120 - RNA, 21 nt, Homo sapiens
guuggaauccauagcggaagg

SEQ ID NO: 6121 - RNA, 21 nt, Homo sapiens
uuggaauccauagcggaaggg

SEQ ID NO: 6122 - RNA, 21 nt, Homo sapiens
uggaauccauagcggaaggga

SEQ ID NO: 6123 - RNA, 21 nt, Homo sapiens
ggaauccauagcggaagggau

SEQ ID NO: 6124 - RNA, 21 nt, Homo sapiens
gaauccauagcggaagggauu

SEQ ID NO: 6125 - RNA, 21 nt, Homo sapiens
aauccauagcggaagggauuu

SEQ ID NO: 6126 - RNA, 21 nt, Homo sapiens
auccauagcggaagggauuuu

SEQ ID NO: 6127 - RNA, 21 nt, Homo sapiens
uccauagcggaagggauuuua

SEQ ID NO: 6128 - RNA, 21 nt, Homo sapiens
ccauagcggaagggauuuuac

SEQ ID NO: 6129 - RNA, 21 nt, Homo sapiens
cauagcggaagggauuuuacu

SEQ ID NO: 6130 - RNA, 21 nt, Homo sapiens
auagcggaagggauuuuacug

SEQ ID NO: 6131 - RNA, 21 nt, Homo sapiens
uagcggaagggauuuuacugc

SEQ ID NO: 6132 - RNA, 21 nt, Homo sapiens
agcggaagggauuuuacugcu

SEQ ID NO: 6133 - RNA, 21 nt, Homo sapiens
gcggaagggauuuuacugcua

SEQ ID NO: 6134 - RNA, 21 nt, Homo sapiens
cggaagggauuuuacugcuau

SEQ ID NO: 6135 - RNA, 21 nt, Homo sapiens
ggaagggauuuuacugcuauu

SEQ ID NO: 6136 - RNA, 21 nt, Homo sapiens
gaagggauuuuacugcuauug

SEQ ID NO: 6137 - RNA, 21 nt, Homo sapiens
aagggauuuuacugcuauugu

SEQ ID NO: 6138 - RNA, 21 nt, Homo sapiens
agggauuuuacugcuauugua

SEQ ID NO: 6139 - RNA, 21 nt, Homo sapiens
gggauuuuacugcuauuguaa

SEQ ID NO: 6140 - RNA, 21 nt, Homo sapiens
ggauuuuacugcuauuguaau

SEQ ID NO: 6141 - RNA, 21 nt, Homo sapiens
gauuuuacugcuauuguaauc

SEQ ID NO: 6142 - RNA, 21 nt, Homo sapiens
auuuuacugcuauuguaauca

SEQ ID NO: 6143 - RNA, 21 nt, Homo sapiens
uuuuacugcuauuguaaucag

SEQ ID NO: 6144 - RNA, 21 nt, Homo sapiens
uuuacugcuauuguaaucagg

SEQ ID NO: 6145 - RNA, 21 nt, Homo sapiens
uuacugcuauuguaaucaggc

SEQ ID NO: 6146 - RNA, 21 nt, Homo sapiens
uacugcuauuguaaucaggcu

SEQ ID NO: 6147 - RNA, 21 nt, Homo sapiens
acugcuauuguaaucaggcug

SEQ ID NO: 6148 - RNA, 21 nt, Homo sapiens
cugcuauuguaaucaggcugu

SEQ ID NO: 6149 - RNA, 21 nt, Homo sapiens
ugcuauuguaaucaggcugug

SEQ ID NO: 6150 - RNA, 21 nt, Homo sapiens
gcuauuguaaucaggcuguga

SEQ ID NO: 6151 - RNA, 21 nt, Homo sapiens
cuauuguaaucaggcugugau

SEQ ID NO: 6152 - RNA, 21 nt, Homo sapiens
uauuguaaucaggcugugaug

SEQ ID NO: 6153 - RNA, 21 nt, Homo sapiens
auuguaaucaggcugugaugg

SEQ ID NO: 6154 - RNA, 21 nt, Homo sapiens
uuguaaucaggcugugauggu

SEQ ID NO: 6155 - RNA, 21 nt, Homo sapiens
uguaaucaggcugugauggua

SEQ ID NO: 6156 - RNA, 21 nt, Homo sapiens
guaaucaggcugugaugguaa

SEQ ID NO: 6157 - RNA, 21 nt, Homo sapiens
uaaucaggcugugaugguaau

SEQ ID NO: 6158 - RNA, 21 nt, Homo sapiens
aaucaggcugugaugguaaua

SEQ ID NO: 6159 - RNA, 21 nt, Homo sapiens
aucaggcugugaugguaauau

SEQ ID NO: 6160 - RNA, 21 nt, Homo sapiens
ucaggcugugaugguaauaug

SEQ ID NO: 6161 - RNA, 21 nt, Homo sapiens
caggcugugaugguaauaugg

SEQ ID NO: 6162 - RNA, 21 nt, Homo sapiens
aggcugugaugguaauaugga

SEQ ID NO: 6163 - RNA, 21 nt, Homo sapiens
ggcugugaugguaauauggag

SEQ ID NO: 6164 - RNA, 21 nt, Homo sapiens
gcugugaugguaauauggagc

SEQ ID NO: 6165 - RNA, 21 nt, Homo sapiens
cugugaugguaauauggagcu

SEQ ID NO: 6166 - RNA, 21 nt, Homo sapiens
ugugaugguaauauggagcug

SEQ ID NO: 6167 - RNA, 21 nt, Homo sapiens
gugaugguaauauggagcuga

SEQ ID NO: 6168 - RNA, 21 nt, Homo sapiens
ugaugguaauauggagcugag

SEQ ID NO: 6169 - RNA, 21 nt, Homo sapiens
gaugguaauauggagcugagg

SEQ ID NO: 6170 - RNA, 21 nt, Homo sapiens
augguaauauggagcugagga

SEQ ID NO: 6171 - RNA, 21 nt, Homo sapiens
ugguaauauggagcugaggaa

SEQ ID NO: 6172 - RNA, 21 nt, Homo sapiens
gguaauauggagcugaggaag

SEQ ID NO: 6173 - RNA, 21 nt, Homo sapiens
guaauauggagcugaggaagc

SEQ ID NO: 6174 - RNA, 21 nt, Homo sapiens
uaauauggagcugaggaagcu

SEQ ID NO: 6175 - RNA, 21 nt, Homo sapiens
aauauggagcugaggaagcug

SEQ ID NO: 6176 - RNA, 21 nt, Homo sapiens
auauggagcugaggaagcugg

SEQ ID NO: 6177 - RNA, 21 nt, Homo sapiens
uauggagcugaggaagcuggc

SEQ ID NO: 6178 - RNA, 21 nt, Homo sapiens
auggagcugaggaagcuggcu

SEQ ID NO: 6179 - RNA, 21 nt, Homo sapiens
uggagcugaggaagcuggcug

SEQ ID NO: 6180 - RNA, 21 nt, Homo sapiens
ggagcugaggaagcuggcugg

SEQ ID NO: 6181 - RNA, 21 nt, Homo sapiens
gagcugaggaagcuggcuggg

SEQ ID NO: 6182 - RNA, 21 nt, Homo sapiens
agcugaggaagcuggcugggg

SEQ ID NO: 6183 - RNA, 21 nt, Homo sapiens
gcugaggaagcuggcugggga

SEQ ID NO: 6184 - RNA, 21 nt, Homo sapiens
cugaggaagcuggcuggggac

SEQ ID NO: 6185 - RNA, 21 nt, Homo sapiens
ugaggaagcuggcuggggacu

SEQ ID NO: 6186 - RNA, 21 nt, Homo sapiens
gaggaagcuggcuggggacug

SEQ ID NO: 6187 - RNA, 21 nt, Homo sapiens
aggaagcuggcuggggacugg

SEQ ID NO: 6188 - RNA, 21 nt, Homo sapiens
ggaagcuggcuggggacuggu

SEQ ID NO: 6189 - RNA, 21 nt, Homo sapiens
gaagcuggcuggggacugguu

SEQ ID NO: 6190 - RNA, 21 nt, Homo sapiens
aagcuggcuggggacugguua

SEQ ID NO: 6191 - RNA, 21 nt, Homo sapiens
agcuggcuggggacugguuau

SEQ ID NO: 6192 - RNA, 21 nt, Homo sapiens
gcuggcuggggacugguuaua

SEQ ID NO: 6193 - RNA, 21 nt, Homo sapiens
cuggcuggggacugguuauag

SEQ ID NO: 6194 - RNA, 21 nt, Homo sapiens
uggcuggggacugguuauagg

SEQ ID NO: 6195 - RNA, 21 nt, Homo sapiens
ggcuggggacugguuauaggu

SEQ ID NO: 6196 - RNA, 21 nt, Homo sapiens
gcuggggacugguuauaggug

SEQ ID NO: 6197 - RNA, 21 nt, Homo sapiens
cuggggacugguuauaggugg

SEQ ID NO: 6198 - RNA, 21 nt, Homo sapiens
uggggacugguuauagguggu

SEQ ID NO: 6199 - RNA, 21 nt, Homo sapiens
ggggacugguuauaggugguu

SEQ ID NO: 6200 - RNA, 21 nt, Homo sapiens
gggacugguuauaggugguug

SEQ ID NO: 6201 - RNA, 21 nt, Homo sapiens
ggacugguuauaggugguugu

SEQ ID NO: 6202 - RNA, 21 nt, Homo sapiens
gacugguuauaggugguugua

SEQ ID NO: 6203 - RNA, 21 nt, Homo sapiens
acugguuauaggugguuguaa

SEQ ID NO: 6204 - RNA, 21 nt, Homo sapiens
cugguuauaggugguuguaac

SEQ ID NO: 6205 - RNA, 21 nt, Homo sapiens
ugguuauaggugguuguaacc

SEQ ID NO: 6206 - RNA, 21 nt, Homo sapiens
gguuauaggugguuguaaccc

SEQ ID NO: 6207 - RNA, 21 nt, Homo sapiens
guuauaggugguuguaacccu

SEQ ID NO: 6208 - RNA, 21 nt, Homo sapiens
uuauaggugguuguaacccuu

SEQ ID NO: 6209 - RNA, 21 nt, Homo sapiens
uauaggugguuguaacccuuu

SEQ ID NO: 6210 - RNA, 21 nt, Homo sapiens
auaggugguuguaacccuuug

SEQ ID NO: 6211 - RNA, 21 nt, Homo sapiens
uaggugguuguaacccuuugg

SEQ ID NO: 6212 - RNA, 21 nt, Homo sapiens
aggugguuguaacccuuuggc

SEQ ID NO: 6213 - RNA, 21 nt, Homo sapiens
ggugguuguaacccuuuggcc

SEQ ID NO: 6214 - RNA, 21 nt, Homo sapiens
gugguuguaacccuuuggccu

SEQ ID NO: 6215 - RNA, 21 nt, Homo sapiens
ugguuguaacccuuuggccug

SEQ ID NO: 6216 - RNA, 21 nt, Homo sapiens
gguuguaacccuuuggccugg

SEQ ID NO: 6217 - RNA, 21 nt, Homo sapiens
guuguaacccuuuggccuggg

SEQ ID NO: 6218 - RNA, 21 nt, Homo sapiens
uuguaacccuuuggccugggu

SEQ ID NO: 6219 - RNA, 21 nt, Homo sapiens
uguaacccuuuggccuggguu

SEQ ID NO: 6220 - RNA, 21 nt, Homo sapiens
guaacccuuuggccuggguug

SEQ ID NO: 6221 - RNA, 21 nt, Homo sapiens
uaacccuuuggccuggguugg

SEQ ID NO: 6222 - RNA, 21 nt, Homo sapiens
aacccuuuggccuggguugga

SEQ ID NO: 6223 - RNA, 21 nt, Homo sapiens
acccuuuggccuggguuggag

SEQ ID NO: 6224 - RNA, 21 nt, Homo sapiens
cccuuuggccuggguuggagc

SEQ ID NO: 6225 - RNA, 21 nt, Homo sapiens
ccuuuggccuggguuggagcc

SEQ ID NO: 6226 - RNA, 21 nt, Homo sapiens
cuuuggccuggguuggagcca

SEQ ID NO: 6227 - RNA, 21 nt, Homo sapiens
uuuggccuggguuggagccag

SEQ ID NO: 6228 - RNA, 21 nt, Homo sapiens
uuggccuggguuggagccagc

SEQ ID NO: 6229 - RNA, 21 nt, Homo sapiens
uggccuggguuggagccagca

SEQ ID NO: 6230 - RNA, 21 nt, Homo sapiens
ggccuggguuggagccagcau

SEQ ID NO: 6231 - RNA, 21 nt, Homo sapiens
gccuggguuggagccagcaug

SEQ ID NO: 6232 - RNA, 21 nt, Homo sapiens
ccuggguuggagccagcaugc

SEQ ID NO: 6233 - RNA, 21 nt, Homo sapiens
cuggguuggagccagcaugcu

SEQ ID NO: 6234 - RNA, 21 nt, Homo sapiens
uggguuggagccagcaugcug

SEQ ID NO: 6235 - RNA, 21 nt, Homo sapiens
ggguuggagccagcaugcugc

SEQ ID NO: 6236 - RNA, 21 nt, Homo sapiens
gguuggagccagcaugcugcu

SEQ ID NO: 6237 - RNA, 21 nt, Homo sapiens
guuggagccagcaugcugcug

SEQ ID NO: 6238 - RNA, 21 nt, Homo sapiens
uuggagccagcaugcugcugg

SEQ ID NO: 6239 - RNA, 21 nt, Homo sapiens
uggagccagcaugcugcuggg

SEQ ID NO: 6240 - RNA, 21 nt, Homo sapiens
ggagccagcaugcugcugggg

SEQ ID NO: 6241 - RNA, 21 nt, Homo sapiens
gagccagcaugcugcugggga

SEQ ID NO: 6242 - RNA, 21 nt, Homo sapiens
agccagcaugcugcuggggag

SEQ ID NO: 6243 - RNA, 21 nt, Homo sapiens
gccagcaugcugcuggggaga

SEQ ID NO: 6244 - RNA, 21 nt, Homo sapiens
ccagcaugcugcuggggagaa

SEQ ID NO: 6245 - RNA, 21 nt, Homo sapiens
cagcaugcugcuggggagaag

SEQ ID NO: 6246 - RNA, 21 nt, Homo sapiens
agcaugcugcuggggagaagc

SEQ ID NO: 6247 - RNA, 21 nt, Homo sapiens
gcaugcugcuggggagaagca

SEQ ID NO: 6248 - RNA, 21 nt, Homo sapiens
caugcugcuggggagaagcag

SEQ ID NO: 6249 - RNA, 21 nt, Homo sapiens
augcugcuggggagaagcagg

SEQ ID NO: 6250 - RNA, 21 nt, Homo sapiens
ugcugcuggggagaagcaggg

SEQ ID NO: 6251 - RNA, 21 nt, Homo sapiens
gcugcuggggagaagcaggga

SEQ ID NO: 6252 - RNA, 21 nt, Homo sapiens
cugcuggggagaagcagggaa

SEQ ID NO: 6253 - RNA, 21 nt, Homo sapiens
ugcuggggagaagcagggaaa

SEQ ID NO: 6254 - RNA, 21 nt, Homo sapiens
gcuggggagaagcagggaaag

SEQ ID NO: 6255 - RNA, 21 nt, Homo sapiens
cuggggagaagcagggaaagc

SEQ ID NO: 6256 - RNA, 21 nt, Homo sapiens
uggggagaagcagggaaagca

SEQ ID NO: 6257 - RNA, 21 nt, Homo sapiens
ggggagaagcagggaaagcag

SEQ ID NO: 6258 - RNA, 21 nt, Homo sapiens
gggagaagcagggaaagcaga

SEQ ID NO: 6259 - RNA, 21 nt, Homo sapiens
ggagaagcagggaaagcagag

SEQ ID NO: 6260 - RNA, 21 nt, Homo sapiens
gagaagcagggaaagcagagg

SEQ ID NO: 6261 - RNA, 21 nt, Homo sapiens
agaagcagggaaagcagagga

SEQ ID NO: 6262 - RNA, 21 nt, Homo sapiens
gaagcagggaaagcagaggag

SEQ ID NO: 6263 - RNA, 21 nt, Homo sapiens
aagcagggaaagcagaggagg

SEQ ID NO: 6264 - RNA, 21 nt, Homo sapiens
agcagggaaagcagaggagga

SEQ ID NO: 6265 - RNA, 21 nt, Homo sapiens
gcagggaaagcagaggaggac

SEQ ID NO: 6266 - RNA, 21 nt, Homo sapiens
cagggaaagcagaggaggaca

SEQ ID NO: 6267 - RNA, 21 nt, Homo sapiens
agggaaagcagaggaggacau

SEQ ID NO: 6268 - RNA, 21 nt, Homo sapiens
gggaaagcagaggaggacaug

SEQ ID NO: 6269 - RNA, 21 nt, Homo sapiens
ggaaagcagaggaggacaugg

SEQ ID NO: 6270 - RNA, 21 nt, Homo sapiens
gaaagcagaggaggacauggu

SEQ ID NO: 6271 - RNA, 21 nt, Homo sapiens
aaagcagaggaggacauggug

SEQ ID NO: 6272 - RNA, 21 nt, Homo sapiens
aagcagaggaggacaugguga

SEQ ID NO: 6273 - RNA, 21 nt, Homo sapiens
agcagaggaggacauggugau

SEQ ID NO: 6274 - RNA, 21 nt, Homo sapiens
gcagaggaggacauggugaug

SEQ ID NO: 6275 - RNA, 21 nt, Homo sapiens
cagaggaggacauggugaugu

SEQ ID NO: 6276 - RNA, 21 nt, Homo sapiens
agaggaggacauggugaugug

SEQ ID NO: 6277 - RNA, 21 nt, Homo sapiens
gaggaggacauggugauguga

SEQ ID NO: 6278 - RNA, 21 nt, Homo sapiens
aggaggacauggugaugugag

SEQ ID NO: 6279 - RNA, 21 nt, Homo sapiens
ggaggacauggugaugugaga

SEQ ID NO: 6280 - RNA, 21 nt, Homo sapiens
gaggacauggugaugugagag

SEQ ID NO: 6281 - RNA, 21 nt, Homo sapiens
aggacauggugaugugagagc

SEQ ID NO: 6282 - RNA, 21 nt, Homo sapiens
ggacauggugaugugagagcu

SEQ ID NO: 6283 - RNA, 21 nt, Homo sapiens
gacauggugaugugagagcuc

SEQ ID NO: 6284 - RNA, 21 nt, Homo sapiens
acauggugaugugagagcuca

SEQ ID NO: 6285 - RNA, 21 nt, Homo sapiens
cauggugaugugagagcucag

SEQ ID NO: 6286 - RNA, 21 nt, Homo sapiens
auggugaugugagagcucagu

SEQ ID NO: 6287 - RNA, 21 nt, Homo sapiens
uggugaugugagagcucagug

SEQ ID NO: 6288 - RNA, 21 nt, Homo sapiens
ggugaugugagagcucagugu

SEQ ID NO: 6289 - RNA, 21 nt, Homo sapiens
gugaugugagagcucaguguu

SEQ ID NO: 6290 - RNA, 21 nt, Homo sapiens
ugaugugagagcucaguguug

SEQ ID NO: 6291 - RNA, 21 nt, Homo sapiens
gaugugagagcucaguguuga

SEQ ID NO: 6292 - RNA, 21 nt, Homo sapiens
augugagagcucaguguugag

SEQ ID NO: 6293 - RNA, 21 nt, Homo sapiens
ugugagagcucaguguugagg

SEQ ID NO: 6294 - RNA, 21 nt, Homo sapiens
gugagagcucaguguugagga

SEQ ID NO: 6295 - RNA, 21 nt, Homo sapiens
ugagagcucaguguugaggag

SEQ ID NO: 6296 - RNA, 21 nt, Homo sapiens
gagagcucaguguugaggagg

SEQ ID NO: 6297 - RNA, 21 nt, Homo sapiens
agagcucaguguugaggaggc

SEQ ID NO: 6298 - RNA, 21 nt, Homo sapiens
gagcucaguguugaggaggca

SEQ ID NO: 6299 - RNA, 21 nt, Homo sapiens
agcucaguguugaggaggcag

SEQ ID NO: 6300 - RNA, 21 nt, Homo sapiens
gcucaguguugaggaggcaga

SEQ ID NO: 6301 - RNA, 21 nt, Homo sapiens
cucaguguugaggaggcagaa

SEQ ID NO: 6302 - RNA, 21 nt, Homo sapiens
ucaguguugaggaggcagaaa

SEQ ID NO: 6303 - RNA, 21 nt, Homo sapiens
caguguugaggaggcagaaaa

SEQ ID NO: 6304 - RNA, 21 nt, Homo sapiens
aguguugaggaggcagaaaau

SEQ ID NO: 6305 - RNA, 21 nt, Homo sapiens
guguugaggaggcagaaaauc

SEQ ID NO: 6306 - RNA, 21 nt, Homo sapiens
uguugaggaggcagaaaaucu

SEQ ID NO: 6307 - RNA, 21 nt, Homo sapiens
guugaggaggcagaaaaucuu

SEQ ID NO: 6308 - RNA, 21 nt, Homo sapiens
uugaggaggcagaaaaucuuu

SEQ ID NO: 6309 - RNA, 21 nt, Homo sapiens
ugaggaggcagaaaaucuuug

SEQ ID NO: 6310 - RNA, 21 nt, Homo sapiens
gaggaggcagaaaaucuuugc

SEQ ID NO: 6311 - RNA, 21 nt, Homo sapiens
aggaggcagaaaaucuuugcu

SEQ ID NO: 6312 - RNA, 21 nt, Homo sapiens
ggaggcagaaaaucuuugcuc

SEQ ID NO: 6313 - RNA, 21 nt, Homo sapiens
gaggcagaaaaucuuugcucu

SEQ ID NO: 6314 - RNA, 21 nt, Homo sapiens
aggcagaaaaucuuugcucug

SEQ ID NO: 6315 - RNA, 21 nt, Homo sapiens
ggcagaaaaucuuugcucugu

SEQ ID NO: 6316 - RNA, 21 nt, Homo sapiens
gcagaaaaucuuugcucugua

SEQ ID NO: 6317 - RNA, 21 nt, Homo sapiens
cagaaaaucuuugcucuguac

SEQ ID NO: 6318 - RNA, 21 nt, Homo sapiens
agaaaaucuuugcucuguaca

SEQ ID NO: 6319 - RNA, 21 nt, Homo sapiens
gaaaaucuuugcucuguacac

SEQ ID NO: 6320 - RNA, 21 nt, Homo sapiens
aaaaucuuugcucuguacacu

SEQ ID NO: 6321 - RNA, 21 nt, Homo sapiens
aaaucuuugcucuguacacug

SEQ ID NO: 6322 - RNA, 21 nt, Homo sapiens
aaucuuugcucuguacacugg

SEQ ID NO: 6323 - RNA, 21 nt, Homo sapiens
aucuuugcucuguacacuggc

SEQ ID NO: 6324 - RNA, 21 nt, Homo sapiens
ucuuugcucuguacacuggcg

SEQ ID NO: 6325 - RNA, 21 nt, Homo sapiens
cuuugcucuguacacuggcgg

SEQ ID NO: 6326 - RNA, 21 nt, Homo sapiens
uuugcucuguacacuggcggg

SEQ ID NO: 6327 - RNA, 21 nt, Homo sapiens
uugcucuguacacuggcgggg

SEQ ID NO: 6328 - RNA, 21 nt, Homo sapiens
ugcucuguacacuggcggggc

SEQ ID NO: 6329 - RNA, 21 nt, Homo sapiens
gcucuguacacuggcggggcu

SEQ ID NO: 6330 - RNA, 21 nt, Homo sapiens
cucuguacacuggcggggcug

SEQ ID NO: 6331 - RNA, 21 nt, Homo sapiens
ucuguacacuggcggggcugg

SEQ ID NO: 6332 - RNA, 21 nt, Homo sapiens
cuguacacuggcggggcugga

SEQ ID NO: 6333 - RNA, 21 nt, Homo sapiens
uguacacuggcggggcuggau

SEQ ID NO: 6334 - RNA, 21 nt, Homo sapiens
guacacuggcggggcuggaug

SEQ ID NO: 6335 - RNA, 21 nt, Homo sapiens
uacacuggcggggcuggauga

SEQ ID NO: 6336 - RNA, 21 nt, Homo sapiens
acacuggcggggcuggaugau

SEQ ID NO: 6337 - RNA, 21 nt, Homo sapiens
cacuggcggggcuggaugaua

SEQ ID NO: 6338 - RNA, 21 nt, Homo sapiens
acuggcggggcuggaugauaa

SEQ ID NO: 6339 - RNA, 21 nt, Homo sapiens
cuggcggggcuggaugauaau

SEQ ID NO: 6340 - RNA, 21 nt, Homo sapiens
uggcggggcuggaugauaaug

SEQ ID NO: 6341 - RNA, 21 nt, Homo sapiens
ggcggggcuggaugauaaugg

SEQ ID NO: 6342 - RNA, 21 nt, Homo sapiens
gcggggcuggaugauaaugga

SEQ ID NO: 6343 - RNA, 21 nt, Homo sapiens
cggggcuggaugauaauggaa

SEQ ID NO: 6344 - RNA, 21 nt, Homo sapiens
ggggcuggaugauaauggaag

SEQ ID NO: 6345 - RNA, 21 nt, Homo sapiens
gggcuggaugauaauggaaga

SEQ ID NO: 6346 - RNA, 21 nt, Homo sapiens
ggcuggaugauaauggaagac

SEQ ID NO: 6347 - RNA, 21 nt, Homo sapiens
gcuggaugauaauggaagacu

SEQ ID NO: 6348 - RNA, 21 nt, Homo sapiens
cuggaugauaauggaagacug

SEQ ID NO: 6349 - RNA, 21 nt, Homo sapiens
uggaugauaauggaagacugu

SEQ ID NO: 6350 - RNA, 21 nt, Homo sapiens
ggaugauaauggaagacuguu

SEQ ID NO: 6351 - RNA, 21 nt, Homo sapiens
gaugauaauggaagacuguuu

SEQ ID NO: 6352 - RNA, 21 nt, Homo sapiens
augauaauggaagacuguuug

SEQ ID NO: 6353 - RNA, 21 nt, Homo sapiens
ugauaauggaagacuguuugg

SEQ ID NO: 6354 - RNA, 21 nt, Homo sapiens
gauaauggaagacuguuuggu

SEQ ID NO: 6355 - RNA, 21 nt, Homo sapiens
auaauggaagacuguuugguc

SEQ ID NO: 6356 - RNA, 21 nt, Homo sapiens
uaauggaagacuguuuggucu

SEQ ID NO: 6357 - RNA, 21 nt, Homo sapiens
aauggaagacuguuuggucug

SEQ ID NO: 6358 - RNA, 21 nt, Homo sapiens
auggaagacuguuuggucugg

SEQ ID NO: 6359 - RNA, 21 nt, Homo sapiens
uggaagacuguuuggucuggc

SEQ ID NO: 6360 - RNA, 21 nt, Homo sapiens
ggaagacuguuuggucuggcu

SEQ ID NO: 6361 - RNA, 21 nt, Homo sapiens
gaagacuguuuggucuggcua

SEQ ID NO: 6362 - RNA, 21 nt, Homo sapiens
aagacuguuuggucuggcuag

SEQ ID NO: 6363 - RNA, 21 nt, Homo sapiens
agacuguuuggucuggcuaga

SEQ ID NO: 6364 - RNA, 21 nt, Homo sapiens
gacuguuuggucuggcuagag

SEQ ID NO: 6365 - RNA, 21 nt, Homo sapiens
acuguuuggucuggcuagaga

SEQ ID NO: 6366 - RNA, 21 nt, Homo sapiens
cuguuuggucuggcuagagaa

SEQ ID NO: 6367 - RNA, 21 nt, Homo sapiens
uguuuggucuggcuagagaag

SEQ ID NO: 6368 - RNA, 21 nt, Homo sapiens
guuuggucuggcuagagaagc

SEQ ID NO: 6369 - RNA, 21 nt, Homo sapiens
uuuggucuggcuagagaagcu

SEQ ID NO: 6370 - RNA, 21 nt, Homo sapiens
uuggucuggcuagagaagcug

SEQ ID NO: 6371 - RNA, 21 nt, Homo sapiens
uggucuggcuagagaagcugg

SEQ ID NO: 6372 - RNA, 21 nt, Homo sapiens
ggucuggcuagagaagcugga

SEQ ID NO: 6373 - RNA, 21 nt, Homo sapiens
gucuggcuagagaagcuggag

SEQ ID NO: 6374 - RNA, 21 nt, Homo sapiens
ucuggcuagagaagcuggagg

SEQ ID NO: 6375 - RNA, 21 nt, Homo sapiens
cuggcuagagaagcuggaggu

SEQ ID NO: 6376 - RNA, 21 nt, Homo sapiens
uggcuagagaagcuggagguu

SEQ ID NO: 6377 - RNA, 21 nt, Homo sapiens
ggcuagagaagcuggagguuu

SEQ ID NO: 6378 - RNA, 21 nt, Homo sapiens
gcuagagaagcuggagguuuc

SEQ ID NO: 6379 - RNA, 21 nt, Homo sapiens
cuagagaagcuggagguuucu

SEQ ID NO: 6380 - RNA, 21 nt, Homo sapiens
uagagaagcuggagguuucug

SEQ ID NO: 6381 - RNA, 21 nt, Homo sapiens
agagaagcuggagguuucugg

SEQ ID NO: 6382 - RNA, 21 nt, Homo sapiens
gagaagcuggagguuucuggu

SEQ ID NO: 6383 - RNA, 21 nt, Homo sapiens
agaagcuggagguuucugguc

SEQ ID NO: 6384 - RNA, 21 nt, Homo sapiens
gaagcuggagguuucuggucc

SEQ ID NO: 6385 - RNA, 21 nt, Homo sapiens
aagcuggagguuucuggucca

SEQ ID NO: 6386 - RNA, 21 nt, Homo sapiens
agcuggagguuucugguccag

SEQ ID NO: 6387 - RNA, 21 nt, Homo sapiens
gcuggagguuucugguccagg

SEQ ID NO: 6388 - RNA, 21 nt, Homo sapiens
cuggagguuucugguccagga

SEQ ID NO: 6389 - RNA, 21 nt, Homo sapiens
uggagguuucugguccaggag

SEQ ID NO: 6390 - RNA, 21 nt, Homo sapiens
ggagguuucugguccaggagg

SEQ ID NO: 6391 - RNA, 21 nt, Homo sapiens
gagguuucugguccaggaggc

SEQ ID NO: 6392 - RNA, 21 nt, Homo sapiens
agguuucugguccaggaggcu

SEQ ID NO: 6393 - RNA, 21 nt, Homo sapiens
gguuucugguccaggaggcug

SEQ ID NO: 6394 - RNA, 21 nt, Homo sapiens
guuucugguccaggaggcugc

SEQ ID NO: 6395 - RNA, 21 nt, Homo sapiens
uuucugguccaggaggcugca

SEQ ID NO: 6396 - RNA, 21 nt, Homo sapiens
uucugguccaggaggcugcaa

SEQ ID NO: 6397 - RNA, 21 nt, Homo sapiens
ucugguccaggaggcugcaau

SEQ ID NO: 6398 - RNA, 21 nt, Homo sapiens
cugguccaggaggcugcaauc

SEQ ID NO: 6399 - RNA, 21 nt, Homo sapiens
ugguccaggaggcugcaaucu

SEQ ID NO: 6400 - RNA, 21 nt, Homo sapiens
gguccaggaggcugcaaucug

SEQ ID NO: 6401 - RNA, 21 nt, Homo sapiens
guccaggaggcugcaaucugg

SEQ ID NO: 6402 - RNA, 21 nt, Homo sapiens
uccaggaggcugcaaucugga

SEQ ID NO: 6403 - RNA, 21 nt, Homo sapiens
ccaggaggcugcaaucuggag

SEQ ID NO: 6404 - RNA, 21 nt, Homo sapiens
caggaggcugcaaucuggagc

SEQ ID NO: 6405 - RNA, 21 nt, Homo sapiens
aggaggcugcaaucuggagcc

SEQ ID NO: 6406 - RNA, 21 nt, Homo sapiens
ggaggcugcaaucuggagcca

SEQ ID NO: 6407 - RNA, 21 nt, Homo sapiens
gaggcugcaaucuggagccac

SEQ ID NO: 6408 - RNA, 21 nt, Homo sapiens
aggcugcaaucuggagccaca

SEQ ID NO: 6409 - RNA, 21 nt, Homo sapiens
ggcugcaaucuggagccacau

SEQ ID NO: 6410 - RNA, 21 nt, Homo sapiens
gcugcaaucuggagccacaug

SEQ ID NO: 6411 - RNA, 21 nt, Homo sapiens
cugcaaucuggagccacaugg

SEQ ID NO: 6412 - RNA, 21 nt, Homo sapiens
ugcaaucuggagccacauggg

SEQ ID NO: 6413 - RNA, 21 nt, Homo sapiens
gcaaucuggagccacaugggu

SEQ ID NO: 6414 - RNA, 21 nt, Homo sapiens
caaucuggagccacauggguu

SEQ ID NO: 6415 - RNA, 21 nt, Homo sapiens
aaucuggagccacauggguuu

SEQ ID NO: 6416 - RNA, 21 nt, Homo sapiens
aucuggagccacauggguuuu

SEQ ID NO: 6417 - RNA, 21 nt, Homo sapiens
ucuggagccacauggguuuug

SEQ ID NO: 6418 - RNA, 21 nt, Homo sapiens
cuggagccacauggguuuugg

SEQ ID NO: 6419 - RNA, 21 nt, Homo sapiens
uggagccacauggguuuuggg

SEQ ID NO: 6420 - RNA, 21 nt, Homo sapiens
ggagccacauggguuuuggga

SEQ ID NO: 6421 - RNA, 21 nt, Homo sapiens
gagccacauggguuuugggac

SEQ ID NO: 6422 - RNA, 21 nt, Homo sapiens
agccacauggguuuugggacu

SEQ ID NO: 6423 - RNA, 21 nt, Homo sapiens
gccacauggguuuugggacug

SEQ ID NO: 6424 - RNA, 21 nt, Homo sapiens
ccacauggguuuugggacugg

SEQ ID NO: 6425 - RNA, 21 nt, Homo sapiens
cacauggguuuugggacugga

SEQ ID NO: 6426 - RNA, 21 nt, Homo sapiens
acauggguuuugggacuggau

SEQ ID NO: 6427 - RNA, 21 nt, Homo sapiens
cauggguuuugggacuggaug

SEQ ID NO: 6428 - RNA, 21 nt, Homo sapiens
auggguuuugggacuggauga

SEQ ID NO: 6429 - RNA, 21 nt, Homo sapiens
uggguuuugggacuggaugaa

SEQ ID NO: 6430 - RNA, 21 nt, Homo sapiens
ggguuuugggacuggaugaag

SEQ ID NO: 6431 - RNA, 21 nt, Homo sapiens
gguuuugggacuggaugaagu

SEQ ID NO: 6432 - RNA, 21 nt, Homo sapiens
guuuugggacuggaugaagug

SEQ ID NO: 6433 - RNA, 21 nt, Homo sapiens
uuuugggacuggaugaagugu

SEQ ID NO: 6434 - RNA, 21 nt, Homo sapiens
uuugggacuggaugaaguguu

SEQ ID NO: 6435 - RNA, 21 nt, Homo sapiens
uugggacuggaugaaguguuu

SEQ ID NO: 6436 - RNA, 21 nt, Homo sapiens
ugggacuggaugaaguguuuu

SEQ ID NO: 6437 - RNA, 21 nt, Homo sapiens
gggacuggaugaaguguuuug

SEQ ID NO: 6438 - RNA, 21 nt, Homo sapiens
ggacuggaugaaguguuuugg

SEQ ID NO: 6439 - RNA, 21 nt, Homo sapiens
gacuggaugaaguguuuugga

SEQ ID NO: 6440 - RNA, 21 nt, Homo sapiens
acuggaugaaguguuuuggac

SEQ ID NO: 6441 - RNA, 21 nt, Homo sapiens
cuggaugaaguguuuuggacg

SEQ ID NO: 6442 - RNA, 21 nt, Homo sapiens
uggaugaaguguuuuggacgu

SEQ ID NO: 6443 - RNA, 21 nt, Homo sapiens
ggaugaaguguuuuggacguu

SEQ ID NO: 6444 - RNA, 21 nt, Homo sapiens
gaugaaguguuuuggacguuc

SEQ ID NO: 6445 - RNA, 21 nt, Homo sapiens
augaaguguuuuggacguucg

SEQ ID NO: 6446 - RNA, 21 nt, Homo sapiens
ugaaguguuuuggacguucgu

SEQ ID NO: 6447 - RNA, 21 nt, Homo sapiens
gaaguguuuuggacguucgua

SEQ ID NO: 6448 - RNA, 21 nt, Homo sapiens
aaguguuuuggacguucguag

SEQ ID NO: 6449 - RNA, 21 nt, Homo sapiens
aguguuuuggacguucguagu

SEQ ID NO: 6450 - RNA, 21 nt, Homo sapiens
guguuuuggacguucguaguu

SEQ ID NO: 6451 - RNA, 21 nt, Homo sapiens
uguuuuggacguucguaguua

SEQ ID NO: 6452 - RNA, 21 nt, Homo sapiens
guuuuggacguucguaguuaa

SEQ ID NO: 6453 - RNA, 21 nt, Homo sapiens
uuuuggacguucguaguuaaa

SEQ ID NO: 6454 - RNA, 21 nt, Homo sapiens
uuuggacguucguaguuaaac

SEQ ID NO: 6455 - RNA, 21 nt, Homo sapiens
uuggacguucguaguuaaaca

SEQ ID NO: 6456 - RNA, 21 nt, Homo sapiens
uggacguucguaguuaaacau

SEQ ID NO: 6457 - RNA, 21 nt, Homo sapiens
ggacguucguaguuaaacaug

SEQ ID NO: 6458 - RNA, 21 nt, Homo sapiens
gacguucguaguuaaacaugc

SEQ ID NO: 6459 - RNA, 21 nt, Homo sapiens
acguucguaguuaaacaugcu

SEQ ID NO: 6460 - RNA, 21 nt, Homo sapiens
cguucguaguuaaacaugcuu

SEQ ID NO: 6461 - RNA, 21 nt, Homo sapiens
guucguaguuaaacaugcuua

SEQ ID NO: 6462 - RNA, 21 nt, Homo sapiens
uucguaguuaaacaugcuuag

SEQ ID NO: 6463 - RNA, 21 nt, Homo sapiens
ucguaguuaaacaugcuuagu

SEQ ID NO: 6464 - RNA, 21 nt, Homo sapiens
cguaguuaaacaugcuuaguu

SEQ ID NO: 6465 - RNA, 21 nt, Homo sapiens
guaguuaaacaugcuuaguug

SEQ ID NO: 6466 - RNA, 21 nt, Homo sapiens
uaguuaaacaugcuuaguugg

SEQ ID NO: 6467 - RNA, 21 nt, Homo sapiens
aguuaaacaugcuuaguuggu

SEQ ID NO: 6468 - RNA, 21 nt, Homo sapiens
guuaaacaugcuuaguuggua

SEQ ID NO: 6469 - RNA, 21 nt, Homo sapiens
uuaaacaugcuuaguugguau

SEQ ID NO: 6470 - RNA, 21 nt, Homo sapiens
uaaacaugcuuaguugguaua

SEQ ID NO: 6471 - RNA, 21 nt, Homo sapiens
aaacaugcuuaguugguauau

SEQ ID NO: 6472 - RNA, 21 nt, Homo sapiens
aacaugcuuaguugguauaug

SEQ ID NO: 6473 - RNA, 21 nt, Homo sapiens
acaugcuuaguugguauaugg

SEQ ID NO: 6474 - RNA, 21 nt, Homo sapiens
caugcuuaguugguauaugga

SEQ ID NO: 6475 - RNA, 21 nt, Homo sapiens
augcuuaguugguauauggaa

SEQ ID NO: 6476 - RNA, 21 nt, Homo sapiens
ugcuuaguugguauauggaag

SEQ ID NO: 6477 - RNA, 21 nt, Homo sapiens
gcuuaguugguauauggaaga

SEQ ID NO: 6478 - RNA, 21 nt, Homo sapiens
cuuaguugguauauggaagau

SEQ ID NO: 6479 - RNA, 21 nt, Homo sapiens
uuaguugguauauggaagaug

SEQ ID NO: 6480 - RNA, 21 nt, Homo sapiens
uaguugguauauggaagauga

SEQ ID NO: 6481 - RNA, 21 nt, Homo sapiens
aguugguauauggaagaugaa

SEQ ID NO: 6482 - RNA, 21 nt, Homo sapiens
guugguauauggaagaugaag

SEQ ID NO: 6483 - RNA, 21 nt, Homo sapiens
uugguauauggaagaugaagg

SEQ ID NO: 6484 - RNA, 21 nt, Homo sapiens
ugguauauggaagaugaaggc

SEQ ID NO: 6485 - RNA, 21 nt, Homo sapiens
gguauauggaagaugaaggca

SEQ ID NO: 6486 - RNA, 21 nt, Homo sapiens
guauauggaagaugaaggcaa

SEQ ID NO: 6487 - RNA, 21 nt, Homo sapiens
uauauggaagaugaaggcaaa

SEQ ID NO: 6488 - RNA, 21 nt, Homo sapiens
auauggaagaugaaggcaaau

SEQ ID NO: 6489 - RNA, 21 nt, Homo sapiens
uauggaagaugaaggcaaauu

SEQ ID NO: 6490 - RNA, 21 nt, Homo sapiens
auggaagaugaaggcaaauua

SEQ ID NO: 6491 - RNA, 21 nt, Homo sapiens
uggaagaugaaggcaaauuau

SEQ ID NO: 6492 - RNA, 21 nt, Homo sapiens
ggaagaugaaggcaaauuauu

SEQ ID NO: 6493 - RNA, 21 nt, Homo sapiens
gaagaugaaggcaaauuauua

SEQ ID NO: 6494 - RNA, 21 nt, Homo sapiens
aagaugaaggcaaauuauuac

SEQ ID NO: 6495 - RNA, 21 nt, Homo sapiens
agaugaaggcaaauuauuacu

SEQ ID NO: 6496 - RNA, 21 nt, Homo sapiens
gaugaaggcaaauuauuacua

SEQ ID NO: 6497 - RNA, 21 nt, Homo sapiens
augaaggcaaauuauuacuau

SEQ ID NO: 6498 - RNA, 21 nt, Homo sapiens
ugaaggcaaauuauuacuaua

SEQ ID NO: 6499 - RNA, 21 nt, Homo sapiens
gaaggcaaauuauuacuauaa

SEQ ID NO: 6500 - RNA, 21 nt, Homo sapiens
aaggcaaauuauuacuauaau

SEQ ID NO: 6501 - RNA, 21 nt, Homo sapiens
aggcaaauuauuacuauaaug

SEQ ID NO: 6502 - RNA, 21 nt, Homo sapiens
ggcaaauuauuacuauaauga

SEQ ID NO: 6503 - RNA, 21 nt, Homo sapiens
gcaaauuauuacuauaaugau

SEQ ID NO: 6504 - RNA, 21 nt, Homo sapiens
caaauuauuacuauaaugauu

SEQ ID NO: 6505 - RNA, 21 nt, Homo sapiens
aaauuauuacuauaaugauuu

SEQ ID NO: 6506 - RNA, 21 nt, Homo sapiens
aauuauuacuauaaugauuug

SEQ ID NO: 6507 - RNA, 21 nt, Homo sapiens
auuauuacuauaaugauuugu

SEQ ID NO: 6508 - RNA, 21 nt, Homo sapiens
uuauuacuauaaugauuuguu

SEQ ID NO: 6509 - RNA, 21 nt, Homo sapiens
uauuacuauaaugauuuguuc

SEQ ID NO: 6510 - RNA, 21 nt, Homo sapiens
auuacuauaaugauuuguucc

SEQ ID NO: 6511 - RNA, 21 nt, Homo sapiens
uuacuauaaugauuuguuccu

SEQ ID NO: 6512 - RNA, 21 nt, Homo sapiens
uacuauaaugauuuguuccug

SEQ ID NO: 6513 - RNA, 21 nt, Homo sapiens
acuauaaugauuuguuccugg

SEQ ID NO: 6514 - RNA, 21 nt, Homo sapiens
cuauaaugauuuguuccugga

SEQ ID NO: 6515 - RNA, 21 nt, Homo sapiens
uauaaugauuuguuccuggaa

SEQ ID NO: 6516 - RNA, 21 nt, Homo sapiens
auaaugauuuguuccuggaag

SEQ ID NO: 6517 - RNA, 21 nt, Homo sapiens
uaaugauuuguuccuggaagg

SEQ ID NO: 6518 - RNA, 21 nt, Homo sapiens
aaugauuuguuccuggaaggg

SEQ ID NO: 6519 - RNA, 21 nt, Homo sapiens
augauuuguuccuggaagggu

SEQ ID NO: 6520 - RNA, 21 nt, Homo sapiens
ugauuuguuccuggaagggug

SEQ ID NO: 6521 - RNA, 21 nt, Homo sapiens
gauuuguuccuggaagggugg

SEQ ID NO: 6522 - RNA, 21 nt, Homo sapiens
auuuguuccuggaaggguggg

SEQ ID NO: 6523 - RNA, 21 nt, Homo sapiens
uuuguuccuggaagggugggg

SEQ ID NO: 6524 - RNA, 21 nt, Homo sapiens
uuguuccuggaaggguggggc

SEQ ID NO: 6525 - RNA, 21 nt, Homo sapiens
uguuccuggaaggguggggcc

SEQ ID NO: 6526 - RNA, 21 nt, Homo sapiens
guuccuggaaggguggggccc

SEQ ID NO: 6527 - RNA, 21 nt, Homo sapiens
uuccuggaaggguggggcccu

SEQ ID NO: 6528 - RNA, 21 nt, Homo sapiens
uccuggaaggguggggcccug

SEQ ID NO: 6529 - RNA, 21 nt, Homo sapiens
ccuggaaggguggggcccuga

SEQ ID NO: 6530 - RNA, 21 nt, Homo sapiens
cuggaaggguggggcccugaa

SEQ ID NO: 6531 - RNA, 21 nt, Homo sapiens
uggaaggguggggcccugaau

SEQ ID NO: 6532 - RNA, 21 nt, Homo sapiens
ggaaggguggggcccugaauu

SEQ ID NO: 6533 - RNA, 21 nt, Homo sapiens
gaaggguggggcccugaauuu

SEQ ID NO: 6534 - RNA, 21 nt, Homo sapiens
aaggguggggcccugaauuug

SEQ ID NO: 6535 - RNA, 21 nt, Homo sapiens
aggguggggcccugaauuugg

SEQ ID NO: 6536 - RNA, 21 nt, Homo sapiens
ggguggggcccugaauuuggg

SEQ ID NO: 6537 - RNA, 21 nt, Homo sapiens
gguggggcccugaauuugggg

SEQ ID NO: 6538 - RNA, 21 nt, Homo sapiens
guggggcccugaauuuggggc

SEQ ID NO: 6539 - RNA, 21 nt, Homo sapiens
uggggcccugaauuuggggcc

SEQ ID NO: 6540 - RNA, 21 nt, Homo sapiens
ggggcccugaauuuggggcca

SEQ ID NO: 6541 - RNA, 21 nt, Homo sapiens
gggcccugaauuuggggccac

SEQ ID NO: 6542 - RNA, 21 nt, Homo sapiens
ggcccugaauuuggggccaca

SEQ ID NO: 6543 - RNA, 21 nt, Homo sapiens
gcccugaauuuggggccacaa

SEQ ID NO: 6544 - RNA, 21 nt, Homo sapiens
cccugaauuuggggccacaag

SEQ ID NO: 6545 - RNA, 21 nt, Homo sapiens
ccugaauuuggggccacaagc

SEQ ID NO: 6546 - RNA, 21 nt, Homo sapiens
cugaauuuggggccacaagcc

SEQ ID NO: 6547 - RNA, 21 nt, Homo sapiens
ugaauuuggggccacaagccu

SEQ ID NO: 6548 - RNA, 21 nt, Homo sapiens
gaauuuggggccacaagccug

SEQ ID NO: 6549 - RNA, 21 nt, Homo sapiens
aauuuggggccacaagccugg

SEQ ID NO: 6550 - RNA, 21 nt, Homo sapiens
auuuggggccacaagccugga

SEQ ID NO: 6551 - RNA, 21 nt, Homo sapiens
uuuggggccacaagccuggaa

SEQ ID NO: 6552 - RNA, 21 nt, Homo sapiens
uuggggccacaagccuggaau

SEQ ID NO: 6553 - RNA, 21 nt, Homo sapiens
uggggccacaagccuggaauu

SEQ ID NO: 6554 - RNA, 21 nt, Homo sapiens
ggggccacaagccuggaauua

SEQ ID NO: 6555 - RNA, 21 nt, Homo sapiens
gggccacaagccuggaauuac

SEQ ID NO: 6556 - RNA, 21 nt, Homo sapiens
ggccacaagccuggaauuacg

SEQ ID NO: 6557 - RNA, 21 nt, Homo sapiens
gccacaagccuggaauuacgg

SEQ ID NO: 6558 - RNA, 21 nt, Homo sapiens
ccacaagccuggaauuacgga

SEQ ID NO: 6559 - RNA, 21 nt, Homo sapiens
cacaagccuggaauuacggaa

SEQ ID NO: 6560 - RNA, 21 nt, Homo sapiens
acaagccuggaauuacggaag

SEQ ID NO: 6561 - RNA, 21 nt, Homo sapiens
caagccuggaauuacggaagg

SEQ ID NO: 6562 - RNA, 21 nt, Homo sapiens
aagccuggaauuacggaaggu

SEQ ID NO: 6563 - RNA, 21 nt, Homo sapiens
agccuggaauuacggaagguu

SEQ ID NO: 6564 - RNA, 21 nt, Homo sapiens
gccuggaauuacggaagguug

SEQ ID NO: 6565 - RNA, 21 nt, Homo sapiens
ccuggaauuacggaagguugu

SEQ ID NO: 6566 - RNA, 21 nt, Homo sapiens
cuggaauuacggaagguugua

SEQ ID NO: 6567 - RNA, 21 nt, Homo sapiens
uggaauuacggaagguuguaa

SEQ ID NO: 6568 - RNA, 21 nt, Homo sapiens
ggaauuacggaagguuguaag

SEQ ID NO: 6569 - RNA, 21 nt, Homo sapiens
gaauuacggaagguuguaagg

SEQ ID NO: 6570 - RNA, 21 nt, Homo sapiens
aauuacggaagguuguaagga

SEQ ID NO: 6571 - RNA, 21 nt, Homo sapiens
auuacggaagguuguaaggaa

SEQ ID NO: 6572 - RNA, 21 nt, Homo sapiens
uuacggaagguuguaaggaau

SEQ ID NO: 6573 - RNA, 21 nt, Homo sapiens
uacggaagguuguaaggaauc

SEQ ID NO: 6574 - RNA, 21 nt, Homo sapiens
acggaagguuguaaggaauca

SEQ ID NO: 6575 - RNA, 21 nt, Homo sapiens
cggaagguuguaaggaaucag

SEQ ID NO: 6576 - RNA, 21 nt, Homo sapiens
ggaagguuguaaggaaucaga

SEQ ID NO: 6577 - RNA, 21 nt, Homo sapiens
gaagguuguaaggaaucagaa

SEQ ID NO: 6578 - RNA, 21 nt, Homo sapiens
aagguuguaaggaaucagaag

SEQ ID NO: 6579 - RNA, 21 nt, Homo sapiens
agguuguaaggaaucagaagc

SEQ ID NO: 6580 - RNA, 21 nt, Homo sapiens
gguuguaaggaaucagaagca

SEQ ID NO: 6581 - RNA, 21 nt, Homo sapiens
guuguaaggaaucagaagcaa

SEQ ID NO: 6582 - RNA, 21 nt, Homo sapiens
uuguaaggaaucagaagcaac

SEQ ID NO: 6583 - RNA, 21 nt, Homo sapiens
uguaaggaaucagaagcaacc

SEQ ID NO: 6584 - RNA, 21 nt, Homo sapiens
guaaggaaucagaagcaaccu

SEQ ID NO: 6585 - RNA, 21 nt, Homo sapiens
uaaggaaucagaagcaaccuu

SEQ ID NO: 6586 - RNA, 21 nt, Homo sapiens
aaggaaucagaagcaaccuug

SEQ ID NO: 6587 - RNA, 21 nt, Homo sapiens
aggaaucagaagcaaccuugg

SEQ ID NO: 6588 - RNA, 21 nt, Homo sapiens
ggaaucagaagcaaccuuggu

SEQ ID NO: 6589 - RNA, 21 nt, Homo sapiens
gaaucagaagcaaccuugguc

SEQ ID NO: 6590 - RNA, 21 nt, Homo sapiens
aaucagaagcaaccuuggucu

SEQ ID NO: 6591 - RNA, 21 nt, Homo sapiens
aucagaagcaaccuuggucug

SEQ ID NO: 6592 - RNA, 21 nt, Homo sapiens
ucagaagcaaccuuggucugc

SEQ ID NO: 6593 - RNA, 21 nt, Homo sapiens
cagaagcaaccuuggucugcu

SEQ ID NO: 6594 - RNA, 21 nt, Homo sapiens
agaagcaaccuuggucugcuc

SEQ ID NO: 6595 - RNA, 21 nt, Homo sapiens
gaagcaaccuuggucugcucu

SEQ ID NO: 6596 - RNA, 21 nt, Homo sapiens
aagcaaccuuggucugcucuu

SEQ ID NO: 6597 - RNA, 21 nt, Homo sapiens
agcaaccuuggucugcucuuc

SEQ ID NO: 6598 - RNA, 21 nt, Homo sapiens
gcaaccuuggucugcucuucc

SEQ ID NO: 6599 - RNA, 21 nt, Homo sapiens
caaccuuggucugcucuuccu

SEQ ID NO: 6600 - RNA, 21 nt, Homo sapiens
aaccuuggucugcucuuccuu

SEQ ID NO: 6601 - RNA, 21 nt, Homo sapiens
accuuggucugcucuuccuug

SEQ ID NO: 6602 - RNA, 21 nt, Homo sapiens
ccuuggucugcucuuccuugu

SEQ ID NO: 6603 - RNA, 21 nt, Homo sapiens
cuuggucugcucuuccuuguu

SEQ ID NO: 6604 - RNA, 21 nt, Homo sapiens
uuggucugcucuuccuuguug

SEQ ID NO: 6605 - RNA, 21 nt, Homo sapiens
uggucugcucuuccuuguuga

SEQ ID NO: 6606 - RNA, 21 nt, Homo sapiens
ggucugcucuuccuuguugag

SEQ ID NO: 6607 - RNA, 21 nt, Homo sapiens
gucugcucuuccuuguugaga

SEQ ID NO: 6608 - RNA, 21 nt, Homo sapiens
ucugcucuuccuuguugagau

SEQ ID NO: 6609 - RNA, 21 nt, Homo sapiens
cugcucuuccuuguugagauc

SEQ ID NO: 6610 - RNA, 21 nt, Homo sapiens
ugcucuuccuuguugagaucc

SEQ ID NO: 6611 - RNA, 21 nt, Homo sapiens
gcucuuccuuguugagauccu

SEQ ID NO: 6612 - RNA, 21 nt, Homo sapiens
cucuuccuuguugagauccug

SEQ ID NO: 6613 - RNA, 21 nt, Homo sapiens
ucuuccuuguugagauccuga

SEQ ID NO: 6614 - RNA, 21 nt, Homo sapiens
cuuccuuguugagauccugag

SEQ ID NO: 6615 - RNA, 21 nt, Homo sapiens
uuccuuguugagauccugaga

SEQ ID NO: 6616 - RNA, 21 nt, Homo sapiens
uccuuguugagauccugagaa

SEQ ID NO: 6617 - RNA, 21 nt, Homo sapiens
ccuuguugagauccugagaau

SEQ ID NO: 6618 - RNA, 21 nt, Homo sapiens
cuuguugagauccugagaaua

SEQ ID NO: 6619 - RNA, 21 nt, Homo sapiens
uuguugagauccugagaauac

SEQ ID NO: 6620 - RNA, 21 nt, Homo sapiens
uguugagauccugagaauacu

SEQ ID NO: 6621 - RNA, 21 nt, Homo sapiens
guugagauccugagaauacug

SEQ ID NO: 6622 - RNA, 21 nt, Homo sapiens
uugagauccugagaauacugu

SEQ ID NO: 6623 - RNA, 21 nt, Homo sapiens
ugagauccugagaauacugug

SEQ ID NO: 6624 - RNA, 21 nt, Homo sapiens
gagauccugagaauacugugc

SEQ ID NO: 6625 - RNA, 21 nt, Homo sapiens
agauccugagaauacugugcu

SEQ ID NO: 6626 - RNA, 21 nt, Homo sapiens
gauccugagaauacugugcuc

SEQ ID NO: 6627 - RNA, 21 nt, Homo sapiens
auccugagaauacugugcucc

SEQ ID NO: 6628 - RNA, 21 nt, Homo sapiens
uccugagaauacugugcuccu

SEQ ID NO: 6629 - RNA, 21 nt, Homo sapiens
ccugagaauacugugcuccug

SEQ ID NO: 6630 - RNA, 21 nt, Homo sapiens
cugagaauacugugcuccugg

SEQ ID NO: 6631 - RNA, 21 nt, Homo sapiens
ugagaauacugugcuccuggc

SEQ ID NO: 6632 - RNA, 21 nt, Homo sapiens
gagaauacugugcuccuggcu

SEQ ID NO: 6633 - RNA, 21 nt, Homo sapiens
agaauacugugcuccuggcuu

SEQ ID NO: 6634 - RNA, 21 nt, Homo sapiens
gaauacugugcuccuggcuuu

SEQ ID NO: 6635 - RNA, 21 nt, Homo sapiens
aauacugugcuccuggcuuug

SEQ ID NO: 6636 - RNA, 21 nt, Homo sapiens
auacugugcuccuggcuuugg

SEQ ID NO: 6637 - RNA, 21 nt, Homo sapiens
uacugugcuccuggcuuuggu

SEQ ID NO: 6638 - RNA, 21 nt, Homo sapiens
acugugcuccuggcuuuggua

SEQ ID NO: 6639 - RNA, 21 nt, Homo sapiens
cugugcuccuggcuuugguag

SEQ ID NO: 6640 - RNA, 21 nt, Homo sapiens
ugugcuccuggcuuugguaga

SEQ ID NO: 6641 - RNA, 21 nt, Homo sapiens
gugcuccuggcuuugguagag

SEQ ID NO: 6642 - RNA, 21 nt, Homo sapiens
ugcuccuggcuuugguagagu

SEQ ID NO: 6643 - RNA, 21 nt, Homo sapiens
gcuccuggcuuugguagagug

SEQ ID NO: 6644 - RNA, 21 nt, Homo sapiens
cuccuggcuuugguagaguga

SEQ ID NO: 6645 - RNA, 21 nt, Homo sapiens
uccuggcuuugguagagugac

SEQ ID NO: 6646 - RNA, 21 nt, Homo sapiens
ccuggcuuugguagagugacc

SEQ ID NO: 6647 - RNA, 21 nt, Homo sapiens
cuggcuuugguagagugaccu

SEQ ID NO: 6648 - RNA, 21 nt, Homo sapiens
uggcuuugguagagugaccuu

SEQ ID NO: 6649 - RNA, 21 nt, Homo sapiens
ggcuuugguagagugaccuuc

SEQ ID NO: 6650 - RNA, 21 nt, Homo sapiens
gcuuugguagagugaccuucu

SEQ ID NO: 6651 - RNA, 21 nt, Homo sapiens
cuuugguagagugaccuucuc

SEQ ID NO: 6652 - RNA, 21 nt, Homo sapiens
uuugguagagugaccuucucu

SEQ ID NO: 6653 - RNA, 21 nt, Homo sapiens
uugguagagugaccuucucuu

SEQ ID NO: 6654 - RNA, 21 nt, Homo sapiens
ugguagagugaccuucucuug

SEQ ID NO: 6655 - RNA, 21 nt, Homo sapiens
gguagagugaccuucucuuga

SEQ ID NO: 6656 - RNA, 21 nt, Homo sapiens
guagagugaccuucucuugaa

SEQ ID NO: 6657 - RNA, 21 nt, Homo sapiens
uagagugaccuucucuugaag

SEQ ID NO: 6658 - RNA, 21 nt, Homo sapiens
agagugaccuucucuugaaga

SEQ ID NO: 6659 - RNA, 21 nt, Homo sapiens
gagugaccuucucuugaagaa

SEQ ID NO: 6660 - RNA, 21 nt, Homo sapiens
agugaccuucucuugaagaau

SEQ ID NO: 6661 - RNA, 21 nt, Homo sapiens
gugaccuucucuugaagaaua

SEQ ID NO: 6662 - RNA, 21 nt, Homo sapiens
ugaccuucucuugaagaauau

SEQ ID NO: 6663 - RNA, 21 nt, Homo sapiens
gaccuucucuugaagaauauu

SEQ ID NO: 6664 - RNA, 21 nt, Homo sapiens
accuucucuugaagaauauug

SEQ ID NO: 6665 - RNA, 21 nt, Homo sapiens
ccuucucuugaagaauauugu

SEQ ID NO: 6666 - RNA, 21 nt, Homo sapiens
cuucucuugaagaauauuguu

SEQ ID NO: 6667 - RNA, 21 nt, Homo sapiens
uucucuugaagaauauuguuc

SEQ ID NO: 6668 - RNA, 21 nt, Homo sapiens
ucucuugaagaauauuguucc

SEQ ID NO: 6669 - RNA, 21 nt, Homo sapiens
cucuugaagaauauuguuccc

SEQ ID NO: 6670 - RNA, 21 nt, Homo sapiens
ucuugaagaauauuguucccg

SEQ ID NO: 6671 - RNA, 21 nt, Homo sapiens
cuugaagaauauuguucccgu

SEQ ID NO: 6672 - RNA, 21 nt, Homo sapiens
uugaagaauauuguucccgua

SEQ ID NO: 6673 - RNA, 21 nt, Homo sapiens
ugaagaauauuguucccguag

SEQ ID NO: 6674 - RNA, 21 nt, Homo sapiens
gaagaauauuguucccguagu

SEQ ID NO: 6675 - RNA, 21 nt, Homo sapiens
aagaauauuguucccguaguu

SEQ ID NO: 6676 - RNA, 21 nt, Homo sapiens
agaauauuguucccguaguuc

SEQ ID NO: 6677 - RNA, 21 nt, Homo sapiens
gaauauuguucccguaguucc

SEQ ID NO: 6678 - RNA, 21 nt, Homo sapiens
aauauuguucccguaguucca

SEQ ID NO: 6679 - RNA, 21 nt, Homo sapiens
auauuguucccguaguuccag

SEQ ID NO: 6680 - RNA, 21 nt, Homo sapiens
uauuguucccguaguuccaga

SEQ ID NO: 6681 - RNA, 21 nt, Homo sapiens
auuguucccguaguuccagag

SEQ ID NO: 6682 - RNA, 21 nt, Homo sapiens
uuguucccguaguuccagagg

SEQ ID NO: 6683 - RNA, 21 nt, Homo sapiens
uguucccguaguuccagaggg

SEQ ID NO: 6684 - RNA, 21 nt, Homo sapiens
guucccguaguuccagagggu

SEQ ID NO: 6685 - RNA, 21 nt, Homo sapiens
uucccguaguuccagagggug

SEQ ID NO: 6686 - RNA, 21 nt, Homo sapiens
ucccguaguuccagagggugc

SEQ ID NO: 6687 - RNA, 21 nt, Homo sapiens
cccguaguuccagagggugcc

SEQ ID NO: 6688 - RNA, 21 nt, Homo sapiens
ccguaguuccagagggugcca

SEQ ID NO: 6689 - RNA, 21 nt, Homo sapiens
cguaguuccagagggugccag

SEQ ID NO: 6690 - RNA, 21 nt, Homo sapiens
guaguuccagagggugccagc

SEQ ID NO: 6691 - RNA, 21 nt, Homo sapiens
uaguuccagagggugccagcu

SEQ ID NO: 6692 - RNA, 21 nt, Homo sapiens
aguuccagagggugccagcug

SEQ ID NO: 6693 - RNA, 21 nt, Homo sapiens
guuccagagggugccagcugg

SEQ ID NO: 6694 - RNA, 21 nt, Homo sapiens
uuccagagggugccagcuggg

SEQ ID NO: 6695 - RNA, 21 nt, Homo sapiens
uccagagggugccagcugggu

SEQ ID NO: 6696 - RNA, 21 nt, Homo sapiens
ccagagggugccagcuggguu

SEQ ID NO: 6697 - RNA, 21 nt, Homo sapiens
cagagggugccagcuggguuu

SEQ ID NO: 6698 - RNA, 21 nt, Homo sapiens
agagggugccagcuggguuua

SEQ ID NO: 6699 - RNA, 21 nt, Homo sapiens
gagggugccagcuggguuuaa

SEQ ID NO: 6700 - RNA, 21 nt, Homo sapiens
agggugccagcuggguuuaac

SEQ ID NO: 6701 - RNA, 21 nt, Homo sapiens
gggugccagcuggguuuaacc

SEQ ID NO: 6702 - RNA, 21 nt, Homo sapiens
ggugccagcuggguuuaaccc

SEQ ID NO: 6703 - RNA, 21 nt, Homo sapiens
gugccagcuggguuuaaccca

SEQ ID NO: 6704 - RNA, 21 nt, Homo sapiens
ugccagcuggguuuaacccac

SEQ ID NO: 6705 - RNA, 21 nt, Homo sapiens
gccagcuggguuuaacccacu

SEQ ID NO: 6706 - RNA, 21 nt, Homo sapiens
ccagcuggguuuaacccacua

SEQ ID NO: 6707 - RNA, 21 nt, Homo sapiens
cagcuggguuuaacccacuau

SEQ ID NO: 6708 - RNA, 21 nt, Homo sapiens
agcuggguuuaacccacuauu

SEQ ID NO: 6709 - RNA, 21 nt, Homo sapiens
gcuggguuuaacccacuauug

SEQ ID NO: 6710 - RNA, 21 nt, Homo sapiens
cuggguuuaacccacuauuga

SEQ ID NO: 6711 - RNA, 21 nt, Homo sapiens
uggguuuaacccacuauugaa

SEQ ID NO: 6712 - RNA, 21 nt, Homo sapiens
ggguuuaacccacuauugaag

SEQ ID NO: 6713 - RNA, 21 nt, Homo sapiens
gguuuaacccacuauugaagg

SEQ ID NO: 6714 - RNA, 21 nt, Homo sapiens
guuuaacccacuauugaaggg

SEQ ID NO: 6715 - RNA, 21 nt, Homo sapiens
uuuaacccacuauugaaggga

SEQ ID NO: 6716 - RNA, 21 nt, Homo sapiens
uuaacccacuauugaagggaa

SEQ ID NO: 6717 - RNA, 21 nt, Homo sapiens
uaacccacuauugaagggaag

SEQ ID NO: 6718 - RNA, 21 nt, Homo sapiens
aacccacuauugaagggaagg

SEQ ID NO: 6719 - RNA, 21 nt, Homo sapiens
acccacuauugaagggaagga

SEQ ID NO: 6720 - RNA, 21 nt, Homo sapiens
cccacuauugaagggaaggaa

SEQ ID NO: 6721 - RNA, 21 nt, Homo sapiens
ccacuauugaagggaaggaag

SEQ ID NO: 6722 - RNA, 21 nt, Homo sapiens
cacuauugaagggaaggaaga

SEQ ID NO: 6723 - RNA, 21 nt, Homo sapiens
acuauugaagggaaggaagag

SEQ ID NO: 6724 - RNA, 21 nt, Homo sapiens
cuauugaagggaaggaagagg

SEQ ID NO: 6725 - RNA, 21 nt, Homo sapiens
uauugaagggaaggaagaggc

SEQ ID NO: 6726 - RNA, 21 nt, Homo sapiens
auugaagggaaggaagaggca

SEQ ID NO: 6727 - RNA, 21 nt, Homo sapiens
uugaagggaaggaagaggcau

SEQ ID NO: 6728 - RNA, 21 nt, Homo sapiens
ugaagggaaggaagaggcauc

SEQ ID NO: 6729 - RNA, 21 nt, Homo sapiens
gaagggaaggaagaggcaucu

SEQ ID NO: 6730 - RNA, 21 nt, Homo sapiens
aagggaaggaagaggcaucuc

SEQ ID NO: 6731 - RNA, 21 nt, Homo sapiens
agggaaggaagaggcaucucc

SEQ ID NO: 6732 - RNA, 21 nt, Homo sapiens
gggaaggaagaggcaucuccu

SEQ ID NO: 6733 - RNA, 21 nt, Homo sapiens
ggaaggaagaggcaucuccuu

SEQ ID NO: 6734 - RNA, 21 nt, Homo sapiens
gaaggaagaggcaucuccuuc

SEQ ID NO: 6735 - RNA, 21 nt, Homo sapiens
aaggaagaggcaucuccuucc

SEQ ID NO: 6736 - RNA, 21 nt, Homo sapiens
aggaagaggcaucuccuuccc

SEQ ID NO: 6737 - RNA, 21 nt, Homo sapiens
ggaagaggcaucuccuucccu

SEQ ID NO: 6738 - RNA, 21 nt, Homo sapiens
gaagaggcaucuccuucccuc

SEQ ID NO: 6739 - RNA, 21 nt, Homo sapiens
aagaggcaucuccuucccuca

SEQ ID NO: 6740 - RNA, 21 nt, Homo sapiens
agaggcaucuccuucccucac

SEQ ID NO: 6741 - RNA, 21 nt, Homo sapiens
gaggcaucuccuucccucaca

SEQ ID NO: 6742 - RNA, 21 nt, Homo sapiens
aggcaucuccuucccucacag

SEQ ID NO: 6743 - RNA, 21 nt, Homo sapiens
ggcaucuccuucccucacaga

SEQ ID NO: 6744 - RNA, 21 nt, Homo sapiens
gcaucuccuucccucacagac

SEQ ID NO: 6745 - RNA, 21 nt, Homo sapiens
caucuccuucccucacagacu

SEQ ID NO: 6746 - RNA, 21 nt, Homo sapiens
aucuccuucccucacagacua

SEQ ID NO: 6747 - RNA, 21 nt, Homo sapiens
ucuccuucccucacagacuaa

SEQ ID NO: 6748 - RNA, 21 nt, Homo sapiens
cuccuucccucacagacuaau

SEQ ID NO: 6749 - RNA, 21 nt, Homo sapiens
uccuucccucacagacuaauc

SEQ ID NO: 6750 - RNA, 21 nt, Homo sapiens
ccuucccucacagacuaaucu

SEQ ID NO: 6751 - RNA, 21 nt, Homo sapiens
cuucccucacagacuaaucua

SEQ ID NO: 6752 - RNA, 21 nt, Homo sapiens
uucccucacagacuaaucuag

SEQ ID NO: 6753 - RNA, 21 nt, Homo sapiens
ucccucacagacuaaucuagu

SEQ ID NO: 6754 - RNA, 21 nt, Homo sapiens
cccucacagacuaaucuagug

SEQ ID NO: 6755 - RNA, 21 nt, Homo sapiens
ccucacagacuaaucuagugg

SEQ ID NO: 6756 - RNA, 21 nt, Homo sapiens
cucacagacuaaucuaguggc

SEQ ID NO: 6757 - RNA, 21 nt, Homo sapiens
ucacagacuaaucuaguggcu

SEQ ID NO: 6758 - RNA, 21 nt, Homo sapiens
cacagacuaaucuaguggcuc

SEQ ID NO: 6759 - RNA, 21 nt, Homo sapiens
acagacuaaucuaguggcucu

SEQ ID NO: 6760 - RNA, 21 nt, Homo sapiens
cagacuaaucuaguggcucug

SEQ ID NO: 6761 - RNA, 21 nt, Homo sapiens
agacuaaucuaguggcucugu

SEQ ID NO: 6762 - RNA, 21 nt, Homo sapiens
gacuaaucuaguggcucugug

SEQ ID NO: 6763 - RNA, 21 nt, Homo sapiens
acuaaucuaguggcucugugc

SEQ ID NO: 6764 - RNA, 21 nt, Homo sapiens
cuaaucuaguggcucugugcu

SEQ ID NO: 6765 - RNA, 21 nt, Homo sapiens
uaaucuaguggcucugugcuu

SEQ ID NO: 6766 - RNA, 22 nt, Homo sapiens
uccguuuuaaauauuugaauuu

SEQ ID NO: 6767 - RNA, 22 nt, Homo sapiens
ccguuuuaaauauuugaauuuu

SEQ ID NO: 6768 - RNA, 22 nt, Homo sapiens
cguuuuaaauauuugaauuuua

SEQ ID NO: 6769 - RNA, 22 nt, Homo sapiens
guuuuaaauauuugaauuuuau

SEQ ID NO: 6770 - RNA, 22 nt, Homo sapiens
uuuuaaauauuugaauuuuauu

SEQ ID NO: 6771 - RNA, 22 nt, Homo sapiens
uuuaaauauuugaauuuuauuu

SEQ ID NO: 6772 - RNA, 22 nt, Homo sapiens
uuaaauauuugaauuuuauuuu

SEQ ID NO: 6773 - RNA, 22 nt, Homo sapiens
uaaauauuugaauuuuauuuuc

SEQ ID NO: 6774 - RNA, 22 nt, Homo sapiens
aaauauuugaauuuuauuuucu

SEQ ID NO: 6775 - RNA, 22 nt, Homo sapiens
aauauuugaauuuuauuuucuu

SEQ ID NO: 6776 - RNA, 22 nt, Homo sapiens
auauuugaauuuuauuuucuuu

SEQ ID NO: 6777 - RNA, 22 nt, Homo sapiens
uauuugaauuuuauuuucuuuu

SEQ ID NO: 6778 - RNA, 22 nt, Homo sapiens
auuugaauuuuauuuucuuuug

SEQ ID NO: 6779 - RNA, 22 nt, Homo sapiens
uuugaauuuuauuuucuuuuga

SEQ ID NO: 6780 - RNA, 22 nt, Homo sapiens
uugaauuuuauuuucuuuugac

SEQ ID NO: 6781 - RNA, 22 nt, Homo sapiens
ugaauuuuauuuucuuuugaca

SEQ ID NO: 6782 - RNA, 22 nt, Homo sapiens
gaauuuuauuuucuuuugacau

SEQ ID NO: 6783 - RNA, 22 nt, Homo sapiens
aauuuuauuuucuuuugacaua

SEQ ID NO: 6784 - RNA, 22 nt, Homo sapiens
auuuuauuuucuuuugacauac

SEQ ID NO: 6785 - RNA, 22 nt, Homo sapiens
uuuuauuuucuuuugacauaca

SEQ ID NO: 6786 - RNA, 22 nt, Homo sapiens
uuuauuuucuuuugacauacaa

SEQ ID NO: 6787 - RNA, 22 nt, Homo sapiens
uuauuuucuuuugacauacaac

SEQ ID NO: 6788 - RNA, 22 nt, Homo sapiens
uauuuucuuuugacauacaacu

SEQ ID NO: 6789 - RNA, 22 nt, Homo sapiens
auuuucuuuugacauacaacug

SEQ ID NO: 6790 - RNA, 22 nt, Homo sapiens
uuuucuuuugacauacaacugu

SEQ ID NO: 6791 - RNA, 22 nt, Homo sapiens
uuucuuuugacauacaacugug

SEQ ID NO: 6792 - RNA, 22 nt, Homo sapiens
uucuuuugacauacaacugugg

SEQ ID NO: 6793 - RNA, 22 nt, Homo sapiens
ucuuuugacauacaacugugga

SEQ ID NO: 6794 - RNA, 22 nt, Homo sapiens
cuuuugacauacaacuguggaa

SEQ ID NO: 6795 - RNA, 22 nt, Homo sapiens
uuuugacauacaacuguggaac

SEQ ID NO: 6796 - RNA, 22 nt, Homo sapiens
uuugacauacaacuguggaaca

SEQ ID NO: 6797 - RNA, 22 nt, Homo sapiens
uugacauacaacuguggaacac

SEQ ID NO: 6798 - RNA, 22 nt, Homo sapiens
ugacauacaacuguggaacacu

SEQ ID NO: 6799 - RNA, 22 nt, Homo sapiens
gacauacaacuguggaacacuc

SEQ ID NO: 6800 - RNA, 22 nt, Homo sapiens
acauacaacuguggaacacuca

SEQ ID NO: 6801 - RNA, 22 nt, Homo sapiens
cauacaacuguggaacacucag

SEQ ID NO: 6802 - RNA, 22 nt, Homo sapiens
auacaacuguggaacacucaga

SEQ ID NO: 6803 - RNA, 22 nt, Homo sapiens
uacaacuguggaacacucagau

SEQ ID NO: 6804 - RNA, 22 nt, Homo sapiens
acaacuguggaacacucagaua

SEQ ID NO: 6805 - RNA, 22 nt, Homo sapiens
caacuguggaacacucagauaa

SEQ ID NO: 6806 - RNA, 22 nt, Homo sapiens
aacuguggaacacucagauaau

SEQ ID NO: 6807 - RNA, 22 nt, Homo sapiens
acuguggaacacucagauaauc

SEQ ID NO: 6808 - RNA, 22 nt, Homo sapiens
cuguggaacacucagauaaucu

SEQ ID NO: 6809 - RNA, 22 nt, Homo sapiens
uguggaacacucagauaaucua

SEQ ID NO: 6810 - RNA, 22 nt, Homo sapiens
guggaacacucagauaaucuau

SEQ ID NO: 6811 - RNA, 22 nt, Homo sapiens
uggaacacucagauaaucuaua

SEQ ID NO: 6812 - RNA, 22 nt, Homo sapiens
ggaacacucagauaaucuauac

SEQ ID NO: 6813 - RNA, 22 nt, Homo sapiens
gaacacucagauaaucuauacc

SEQ ID NO: 6814 - RNA, 22 nt, Homo sapiens
aacacucagauaaucuauacca

SEQ ID NO: 6815 - RNA, 22 nt, Homo sapiens
acacucagauaaucuauaccau

SEQ ID NO: 6816 - RNA, 22 nt, Homo sapiens
cacucagauaaucuauaccaug

SEQ ID NO: 6817 - RNA, 22 nt, Homo sapiens
acucagauaaucuauaccaugu

SEQ ID NO: 6818 - RNA, 22 nt, Homo sapiens
cucagauaaucuauaccauguu

SEQ ID NO: 6819 - RNA, 22 nt, Homo sapiens
ucagauaaucuauaccauguua

SEQ ID NO: 6820 - RNA, 22 nt, Homo sapiens
cagauaaucuauaccauguuag

SEQ ID NO: 6821 - RNA, 22 nt, Homo sapiens
agauaaucuauaccauguuagu

SEQ ID NO: 6822 - RNA, 22 nt, Homo sapiens
gauaaucuauaccauguuagua

SEQ ID NO: 6823 - RNA, 22 nt, Homo sapiens
auaaucuauaccauguuaguau

SEQ ID NO: 6824 - RNA, 22 nt, Homo sapiens
uaaucuauaccauguuaguauu

SEQ ID NO: 6825 - RNA, 22 nt, Homo sapiens
aaucuauaccauguuaguauuc

SEQ ID NO: 6826 - RNA, 22 nt, Homo sapiens
aucuauaccauguuaguauucc

SEQ ID NO: 6827 - RNA, 22 nt, Homo sapiens
ucuauaccauguuaguauuccu

SEQ ID NO: 6828 - RNA, 22 nt, Homo sapiens
cuauaccauguuaguauuccua

SEQ ID NO: 6829 - RNA, 22 nt, Homo sapiens
uauaccauguuaguauuccuac

SEQ ID NO: 6830 - RNA, 22 nt, Homo sapiens
auaccauguuaguauuccuaca

SEQ ID NO: 6831 - RNA, 22 nt, Homo sapiens
uaccauguuaguauuccuacaa

SEQ ID NO: 6832 - RNA, 22 nt, Homo sapiens
accauguuaguauuccuacaag

SEQ ID NO: 6833 - RNA, 22 nt, Homo sapiens
ccauguuaguauuccuacaaga

SEQ ID NO: 6834 - RNA, 22 nt, Homo sapiens
cauguuaguauuccuacaagag

SEQ ID NO: 6835 - RNA, 22 nt, Homo sapiens
auguuaguauuccuacaagaga

SEQ ID NO: 6836 - RNA, 22 nt, Homo sapiens
uguuaguauuccuacaagagaa

SEQ ID NO: 6837 - RNA, 22 nt, Homo sapiens
guuaguauuccuacaagagaaa

SEQ ID NO: 6838 - RNA, 22 nt, Homo sapiens
uuaguauuccuacaagagaaaa

SEQ ID NO: 6839 - RNA, 22 nt, Homo sapiens
uaguauuccuacaagagaaaac

SEQ ID NO: 6840 - RNA, 22 nt, Homo sapiens
aguauuccuacaagagaaaacg

SEQ ID NO: 6841 - RNA, 22 nt, Homo sapiens
guauuccuacaagagaaaacgg

SEQ ID NO: 6842 - RNA, 22 nt, Homo sapiens
uauuccuacaagagaaaacggg

SEQ ID NO: 6843 - RNA, 22 nt, Homo sapiens
auuccuacaagagaaaacgggu

SEQ ID NO: 6844 - RNA, 22 nt, Homo sapiens
uuccuacaagagaaaacgggua

SEQ ID NO: 6845 - RNA, 22 nt, Homo sapiens
uccuacaagagaaaacggguaa

SEQ ID NO: 6846 - RNA, 22 nt, Homo sapiens
ccuacaagagaaaacggguaaa

SEQ ID NO: 6847 - RNA, 22 nt, Homo sapiens
cuacaagagaaaacggguaaaa

SEQ ID NO: 6848 - RNA, 22 nt, Homo sapiens
uacaagagaaaacggguaaaac

SEQ ID NO: 6849 - RNA, 22 nt, Homo sapiens
acaagagaaaacggguaaaaca

SEQ ID NO: 6850 - RNA, 22 nt, Homo sapiens
caagagaaaacggguaaaacag

SEQ ID NO: 6851 - RNA, 22 nt, Homo sapiens
aagagaaaacggguaaaacagu

SEQ ID NO: 6852 - RNA, 22 nt, Homo sapiens
agagaaaacggguaaaacagua

SEQ ID NO: 6853 - RNA, 22 nt, Homo sapiens
gagaaaacggguaaaacaguau

SEQ ID NO: 6854 - RNA, 22 nt, Homo sapiens
agaaaacggguaaaacaguauu

SEQ ID NO: 6855 - RNA, 22 nt, Homo sapiens
gaaaacggguaaaacaguauuu

SEQ ID NO: 6856 - RNA, 22 nt, Homo sapiens
aaaacggguaaaacaguauuua

SEQ ID NO: 6857 - RNA, 22 nt, Homo sapiens
aaacggguaaaacaguauuuag

SEQ ID NO: 6858 - RNA, 22 nt, Homo sapiens
aacggguaaaacaguauuuaga

SEQ ID NO: 6859 - RNA, 22 nt, Homo sapiens
acggguaaaacaguauuuagaa

SEQ ID NO: 6860 - RNA, 22 nt, Homo sapiens
cggguaaaacaguauuuagaaa

SEQ ID NO: 6861 - RNA, 22 nt, Homo sapiens
ggguaaaacaguauuuagaaag

SEQ ID NO: 6862 - RNA, 22 nt, Homo sapiens
gguaaaacaguauuuagaaagc

SEQ ID NO: 6863 - RNA, 22 nt, Homo sapiens
guaaaacaguauuuagaaagca

SEQ ID NO: 6864 - RNA, 22 nt, Homo sapiens
uaaaacaguauuuagaaagcag

SEQ ID NO: 6865 - RNA, 22 nt, Homo sapiens
aaaacaguauuuagaaagcagu

SEQ ID NO: 6866 - RNA, 22 nt, Homo sapiens
aaacaguauuuagaaagcagua

SEQ ID NO: 6867 - RNA, 22 nt, Homo sapiens
aacaguauuuagaaagcaguac

SEQ ID NO: 6868 - RNA, 22 nt, Homo sapiens
acaguauuuagaaagcaguacc

SEQ ID NO: 6869 - RNA, 22 nt, Homo sapiens
caguauuuagaaagcaguacca

SEQ ID NO: 6870 - RNA, 22 nt, Homo sapiens
aguauuuagaaagcaguaccag

SEQ ID NO: 6871 - RNA, 22 nt, Homo sapiens
guauuuagaaagcaguaccagu

SEQ ID NO: 6872 - RNA, 22 nt, Homo sapiens
uauuuagaaagcaguaccagua

SEQ ID NO: 6873 - RNA, 22 nt, Homo sapiens
auuuagaaagcaguaccaguaa

SEQ ID NO: 6874 - RNA, 22 nt, Homo sapiens
uuuagaaagcaguaccaguaaa

SEQ ID NO: 6875 - RNA, 22 nt, Homo sapiens
uuagaaagcaguaccaguaaac

SEQ ID NO: 6876 - RNA, 22 nt, Homo sapiens
uagaaagcaguaccaguaaacg

SEQ ID NO: 6877 - RNA, 22 nt, Homo sapiens
agaaagcaguaccaguaaacgu

SEQ ID NO: 6878 - RNA, 22 nt, Homo sapiens
gaaagcaguaccaguaaacguu

SEQ ID NO: 6879 - RNA, 22 nt, Homo sapiens
aaagcaguaccaguaaacguua

SEQ ID NO: 6880 - RNA, 22 nt, Homo sapiens
aagcaguaccaguaaacguuau

SEQ ID NO: 6881 - RNA, 22 nt, Homo sapiens
agcaguaccaguaaacguuauu

SEQ ID NO: 6882 - RNA, 22 nt, Homo sapiens
gcaguaccaguaaacguuauua

SEQ ID NO: 6883 - RNA, 22 nt, Homo sapiens
caguaccaguaaacguuauuac

SEQ ID NO: 6884 - RNA, 22 nt, Homo sapiens
aguaccaguaaacguuauuaca

SEQ ID NO: 6885 - RNA, 22 nt, Homo sapiens
guaccaguaaacguuauuacaa

SEQ ID NO: 6886 - RNA, 22 nt, Homo sapiens
uaccaguaaacguuauuacaag

SEQ ID NO: 6887 - RNA, 22 nt, Homo sapiens
accaguaaacguuauuacaagc

SEQ ID NO: 6888 - RNA, 22 nt, Homo sapiens
ccaguaaacguuauuacaagca

SEQ ID NO: 6889 - RNA, 22 nt, Homo sapiens
caguaaacguuauuacaagcau

SEQ ID NO: 6890 - RNA, 22 nt, Homo sapiens
aguaaacguuauuacaagcauu

SEQ ID NO: 6891 - RNA, 22 nt, Homo sapiens
guaaacguuauuacaagcauua

SEQ ID NO: 6892 - RNA, 22 nt, Homo sapiens
uaaacguuauuacaagcauuag

SEQ ID NO: 6893 - RNA, 22 nt, Homo sapiens
aaacguuauuacaagcauuaga

SEQ ID NO: 6894 - RNA, 22 nt, Homo sapiens
aacguuauuacaagcauuagau

SEQ ID NO: 6895 - RNA, 22 nt, Homo sapiens
acguuauuacaagcauuagaug

SEQ ID NO: 6896 - RNA, 22 nt, Homo sapiens
cguuauuacaagcauuagaugu

SEQ ID NO: 6897 - RNA, 22 nt, Homo sapiens
guuauuacaagcauuagaugug

SEQ ID NO: 6898 - RNA, 22 nt, Homo sapiens
uuauuacaagcauuagaugugu

SEQ ID NO: 6899 - RNA, 22 nt, Homo sapiens
uauuacaagcauuagauguguu

SEQ ID NO: 6900 - RNA, 22 nt, Homo sapiens
auuacaagcauuagauguguuu

SEQ ID NO: 6901 - RNA, 22 nt, Homo sapiens
uuacaagcauuagauguguuua

SEQ ID NO: 6902 - RNA, 22 nt, Homo sapiens
uacaagcauuagauguguuuaa

SEQ ID NO: 6903 - RNA, 22 nt, Homo sapiens
acaagcauuagauguguuuaaa

SEQ ID NO: 6904 - RNA, 22 nt, Homo sapiens
caagcauuagauguguuuaaaa

SEQ ID NO: 6905 - RNA, 22 nt, Homo sapiens
aagcauuagauguguuuaaaaa

SEQ ID NO: 6906 - RNA, 22 nt, Homo sapiens
agcauuagauguguuuaaaaag

SEQ ID NO: 6907 - RNA, 22 nt, Homo sapiens
gcauuagauguguuuaaaaagu

SEQ ID NO: 6908 - RNA, 22 nt, Homo sapiens
cauuagauguguuuaaaaaguu

SEQ ID NO: 6909 - RNA, 22 nt, Homo sapiens
auuagauguguuuaaaaaguug

SEQ ID NO: 6910 - RNA, 22 nt, Homo sapiens
uuagauguguuuaaaaaguuga

SEQ ID NO: 6911 - RNA, 22 nt, Homo sapiens
uagauguguuuaaaaaguugau

SEQ ID NO: 6912 - RNA, 22 nt, Homo sapiens
agauguguuuaaaaaguugaua

SEQ ID NO: 6913 - RNA, 22 nt, Homo sapiens
gauguguuuaaaaaguugauac

SEQ ID NO: 6914 - RNA, 22 nt, Homo sapiens
auguguuuaaaaaguugauacu

SEQ ID NO: 6915 - RNA, 22 nt, Homo sapiens
uguguuuaaaaaguugauacua

SEQ ID NO: 6916 - RNA, 22 nt, Homo sapiens
guguuuaaaaaguugauacuaa

SEQ ID NO: 6917 - RNA, 22 nt, Homo sapiens
uguuuaaaaaguugauacuaau

SEQ ID NO: 6918 - RNA, 22 nt, Homo sapiens
guuuaaaaaguugauacuaauu

SEQ ID NO: 6919 - RNA, 22 nt, Homo sapiens
uuuaaaaaguugauacuaauuu

SEQ ID NO: 6920 - RNA, 22 nt, Homo sapiens
uuaaaaaguugauacuaauuua

SEQ ID NO: 6921 - RNA, 22 nt, Homo sapiens
uaaaaaguugauacuaauuuau

SEQ ID NO: 6922 - RNA, 22 nt, Homo sapiens
aaaaaguugauacuaauuuaua

SEQ ID NO: 6923 - RNA, 22 nt, Homo sapiens
aaaaguugauacuaauuuauaa

SEQ ID NO: 6924 - RNA, 22 nt, Homo sapiens
aaaguugauacuaauuuauaac

SEQ ID NO: 6925 - RNA, 22 nt, Homo sapiens
aaguugauacuaauuuauaacc

SEQ ID NO: 6926 - RNA, 22 nt, Homo sapiens
aguugauacuaauuuauaaccu

SEQ ID NO: 6927 - RNA, 22 nt, Homo sapiens
guugauacuaauuuauaaccug

SEQ ID NO: 6928 - RNA, 22 nt, Homo sapiens
uugauacuaauuuauaaccugu

SEQ ID NO: 6929 - RNA, 22 nt, Homo sapiens
ugauacuaauuuauaaccugua

SEQ ID NO: 6930 - RNA, 22 nt, Homo sapiens
gauacuaauuuauaaccuguaa

SEQ ID NO: 6931 - RNA, 22 nt, Homo sapiens
auacuaauuuauaaccuguaau

SEQ ID NO: 6932 - RNA, 22 nt, Homo sapiens
uacuaauuuauaaccuguaauu

SEQ ID NO: 6933 - RNA, 22 nt, Homo sapiens
acuaauuuauaaccuguaauug

SEQ ID NO: 6934 - RNA, 22 nt, Homo sapiens
cuaauuuauaaccuguaauugu

SEQ ID NO: 6935 - RNA, 22 nt, Homo sapiens
uaauuuauaaccuguaauuguu

SEQ ID NO: 6936 - RNA, 22 nt, Homo sapiens
aauuuauaaccuguaauuguua

SEQ ID NO: 6937 - RNA, 22 nt, Homo sapiens
auuuauaaccuguaauuguuaa

SEQ ID NO: 6938 - RNA, 22 nt, Homo sapiens
uuuauaaccuguaauuguuaaa

SEQ ID NO: 6939 - RNA, 22 nt, Homo sapiens
uuauaaccuguaauuguuaaau

SEQ ID NO: 6940 - RNA, 22 nt, Homo sapiens
uauaaccuguaauuguuaaaug

SEQ ID NO: 6941 - RNA, 22 nt, Homo sapiens
auaaccuguaauuguuaaaugu

SEQ ID NO: 6942 - RNA, 22 nt, Homo sapiens
uaaccuguaauuguuaaaugug

SEQ ID NO: 6943 - RNA, 22 nt, Homo sapiens
aaccuguaauuguuaaaugugc

SEQ ID NO: 6944 - RNA, 22 nt, Homo sapiens
accuguaauuguuaaaugugca

SEQ ID NO: 6945 - RNA, 22 nt, Homo sapiens
ccuguaauuguuaaaugugcau

SEQ ID NO: 6946 - RNA, 22 nt, Homo sapiens
cuguaauuguuaaaugugcaug

SEQ ID NO: 6947 - RNA, 22 nt, Homo sapiens
uguaauuguuaaaugugcauga

SEQ ID NO: 6948 - RNA, 22 nt, Homo sapiens
guaauuguuaaaugugcaugac

SEQ ID NO: 6949 - RNA, 22 nt, Homo sapiens
uaauuguuaaaugugcaugacu

SEQ ID NO: 6950 - RNA, 22 nt, Homo sapiens
aauuguuaaaugugcaugacuu

SEQ ID NO: 6951 - RNA, 22 nt, Homo sapiens
auuguuaaaugugcaugacuua

SEQ ID NO: 6952 - RNA, 22 nt, Homo sapiens
uuguuaaaugugcaugacuuaa

SEQ ID NO: 6953 - RNA, 22 nt, Homo sapiens
uguuaaaugugcaugacuuaaa

SEQ ID NO: 6954 - RNA, 22 nt, Homo sapiens
guuaaaugugcaugacuuaaau

SEQ ID NO: 6955 - RNA, 22 nt, Homo sapiens
uuaaaugugcaugacuuaaaug

SEQ ID NO: 6956 - RNA, 22 nt, Homo sapiens
uaaaugugcaugacuuaaaugu

SEQ ID NO: 6957 - RNA, 22 nt, Homo sapiens
aaaugugcaugacuuaaauguu

SEQ ID NO: 6958 - RNA, 22 nt, Homo sapiens
aaugugcaugacuuaaauguua

SEQ ID NO: 6959 - RNA, 22 nt, Homo sapiens
augugcaugacuuaaauguuaa

SEQ ID NO: 6960 - RNA, 22 nt, Homo sapiens
ugugcaugacuuaaauguuaaa

SEQ ID NO: 6961 - RNA, 22 nt, Homo sapiens
gugcaugacuuaaauguuaaaa

SEQ ID NO: 6962 - RNA, 22 nt, Homo sapiens
ugcaugacuuaaauguuaaaau

SEQ ID NO: 6963 - RNA, 22 nt, Homo sapiens
gcaugacuuaaauguuaaaauc

SEQ ID NO: 6964 - RNA, 22 nt, Homo sapiens
caugacuuaaauguuaaaaucc

SEQ ID NO: 6965 - RNA, 22 nt, Homo sapiens
augacuuaaauguuaaaauccu

SEQ ID NO: 6966 - RNA, 22 nt, Homo sapiens
ugacuuaaauguuaaaauccug

SEQ ID NO: 6967 - RNA, 22 nt, Homo sapiens
gacuuaaauguuaaaauccugu

SEQ ID NO: 6968 - RNA, 22 nt, Homo sapiens
acuuaaauguuaaaauccugua

SEQ ID NO: 6969 - RNA, 22 nt, Homo sapiens
cuuaaauguuaaaauccuguau

SEQ ID NO: 6970 - RNA, 22 nt, Homo sapiens
uuaaauguuaaaauccuguauu

SEQ ID NO: 6971 - RNA, 22 nt, Homo sapiens
uaaauguuaaaauccuguauuu

SEQ ID NO: 6972 - RNA, 22 nt, Homo sapiens
aaauguuaaaauccuguauuuu

SEQ ID NO: 6973 - RNA, 22 nt, Homo sapiens
aauguuaaaauccuguauuuua

SEQ ID NO: 6974 - RNA, 22 nt, Homo sapiens
auguuaaaauccuguauuuuaa

SEQ ID NO: 6975 - RNA, 22 nt, Homo sapiens
uguuaaaauccuguauuuuaag

SEQ ID NO: 6976 - RNA, 22 nt, Homo sapiens
guuaaaauccuguauuuuaaga

SEQ ID NO: 6977 - RNA, 22 nt, Homo sapiens
uuaaaauccuguauuuuaagau

SEQ ID NO: 6978 - RNA, 22 nt, Homo sapiens
uaaaauccuguauuuuaagaua

SEQ ID NO: 6979 - RNA, 22 nt, Homo sapiens
aaaauccuguauuuuaagauag

SEQ ID NO: 6980 - RNA, 22 nt, Homo sapiens
aaauccuguauuuuaagauagu

SEQ ID NO: 6981 - RNA, 22 nt, Homo sapiens
aauccuguauuuuaagauaguc

SEQ ID NO: 6982 - RNA, 22 nt, Homo sapiens
auccuguauuuuaagauagucu

SEQ ID NO: 6983 - RNA, 22 nt, Homo sapiens
uccuguauuuuaagauagucuu

SEQ ID NO: 6984 - RNA, 22 nt, Homo sapiens
ccuguauuuuaagauagucuuc

SEQ ID NO: 6985 - RNA, 22 nt, Homo sapiens
cuguauuuuaagauagucuucu

SEQ ID NO: 6986 - RNA, 22 nt, Homo sapiens
uguauuuuaagauagucuucug

SEQ ID NO: 6987 - RNA, 22 nt, Homo sapiens
guauuuuaagauagucuucugc

SEQ ID NO: 6988 - RNA, 22 nt, Homo sapiens
uauuuuaagauagucuucugca

SEQ ID NO: 6989 - RNA, 22 nt, Homo sapiens
auuuuaagauagucuucugcag

SEQ ID NO: 6990 - RNA, 22 nt, Homo sapiens
uuuuaagauagucuucugcagu

SEQ ID NO: 6991 - RNA, 22 nt, Homo sapiens
uuuaagauagucuucugcaguu

SEQ ID NO: 6992 - RNA, 22 nt, Homo sapiens
uuaagauagucuucugcaguua

SEQ ID NO: 6993 - RNA, 22 nt, Homo sapiens
uaagauagucuucugcaguuac

SEQ ID NO: 6994 - RNA, 22 nt, Homo sapiens
aagauagucuucugcaguuaca

SEQ ID NO: 6995 - RNA, 22 nt, Homo sapiens
agauagucuucugcaguuacaa

SEQ ID NO: 6996 - RNA, 22 nt, Homo sapiens
gauagucuucugcaguuacaaa

SEQ ID NO: 6997 - RNA, 22 nt, Homo sapiens
auagucuucugcaguuacaaau

SEQ ID NO: 6998 - RNA, 22 nt, Homo sapiens
uagucuucugcaguuacaaauc

SEQ ID NO: 6999 - RNA, 22 nt, Homo sapiens
agucuucugcaguuacaaaucc

SEQ ID NO: 7000 - RNA, 22 nt, Homo sapiens
gucuucugcaguuacaaaucca

SEQ ID NO: 7001 - RNA, 22 nt, Homo sapiens
ucuucugcaguuacaaauccau

SEQ ID NO: 7002 - RNA, 22 nt, Homo sapiens
cuucugcaguuacaaauccaua

SEQ ID NO: 7003 - RNA, 22 nt, Homo sapiens
uucugcaguuacaaauccauau

SEQ ID NO: 7004 - RNA, 22 nt, Homo sapiens
ucugcaguuacaaauccauaua

SEQ ID NO: 7005 - RNA, 22 nt, Homo sapiens
cugcaguuacaaauccauauac

SEQ ID NO: 7006 - RNA, 22 nt, Homo sapiens
ugcaguuacaaauccauauacc

SEQ ID NO: 7007 - RNA, 22 nt, Homo sapiens
gcaguuacaaauccauauaccc

SEQ ID NO: 7008 - RNA, 22 nt, Homo sapiens
caguuacaaauccauauaccca

SEQ ID NO: 7009 - RNA, 22 nt, Homo sapiens
aguuacaaauccauauacccag

SEQ ID NO: 7010 - RNA, 22 nt, Homo sapiens
guuacaaauccauauacccaga

SEQ ID NO: 7011 - RNA, 22 nt, Homo sapiens
uuacaaauccauauacccagau

SEQ ID NO: 7012 - RNA, 22 nt, Homo sapiens
uacaaauccauauacccagauu

SEQ ID NO: 7013 - RNA, 22 nt, Homo sapiens
acaaauccauauacccagauuu

SEQ ID NO: 7014 - RNA, 22 nt, Homo sapiens
caaauccauauacccagauuuc

SEQ ID NO: 7015 - RNA, 22 nt, Homo sapiens
aaauccauauacccagauuucc

SEQ ID NO: 7016 - RNA, 22 nt, Homo sapiens
aauccauauacccagauuuccu

SEQ ID NO: 7017 - RNA, 22 nt, Homo sapiens
auccauauacccagauuuccug

SEQ ID NO: 7018 - RNA, 22 nt, Homo sapiens
uccauauacccagauuuccugu

SEQ ID NO: 7019 - RNA, 22 nt, Homo sapiens
ccauauacccagauuuccugua

SEQ ID NO: 7020 - RNA, 22 nt, Homo sapiens
cauauacccagauuuccuguag

SEQ ID NO: 7021 - RNA, 22 nt, Homo sapiens
auauacccagauuuccuguagg

SEQ ID NO: 7022 - RNA, 22 nt, Homo sapiens
uauacccagauuuccuguaggc

SEQ ID NO: 7023 - RNA, 22 nt, Homo sapiens
auacccagauuuccuguaggcu

SEQ ID NO: 7024 - RNA, 22 nt, Homo sapiens
uacccagauuuccuguaggcuu

SEQ ID NO: 7025 - RNA, 22 nt, Homo sapiens
acccagauuuccuguaggcuuc

SEQ ID NO: 7026 - RNA, 22 nt, Homo sapiens
cccagauuuccuguaggcuuca

SEQ ID NO: 7027 - RNA, 22 nt, Homo sapiens
ccagauuuccuguaggcuucac

SEQ ID NO: 7028 - RNA, 22 nt, Homo sapiens
cagauuuccuguaggcuucaca

SEQ ID NO: 7029 - RNA, 22 nt, Homo sapiens
agauuuccuguaggcuucacaa

SEQ ID NO: 7030 - RNA, 22 nt, Homo sapiens
gauuuccuguaggcuucacaaa

SEQ ID NO: 7031 - RNA, 22 nt, Homo sapiens
auuuccuguaggcuucacaaau

SEQ ID NO: 7032 - RNA, 22 nt, Homo sapiens
uuuccuguaggcuucacaaauc

SEQ ID NO: 7033 - RNA, 22 nt, Homo sapiens
uuccuguaggcuucacaaaucg

SEQ ID NO: 7034 - RNA, 22 nt, Homo sapiens
uccuguaggcuucacaaaucgg

SEQ ID NO: 7035 - RNA, 22 nt, Homo sapiens
ccuguaggcuucacaaaucgga

SEQ ID NO: 7036 - RNA, 22 nt, Homo sapiens
cuguaggcuucacaaaucggag

SEQ ID NO: 7037 - RNA, 22 nt, Homo sapiens
uguaggcuucacaaaucggagg

SEQ ID NO: 7038 - RNA, 22 nt, Homo sapiens
guaggcuucacaaaucggaggg

SEQ ID NO: 7039 - RNA, 22 nt, Homo sapiens
uaggcuucacaaaucggagggg

SEQ ID NO: 7040 - RNA, 22 nt, Homo sapiens
aggcuucacaaaucggaggggu

SEQ ID NO: 7041 - RNA, 22 nt, Homo sapiens
ggcuucacaaaucggaggggua

SEQ ID NO: 7042 - RNA, 22 nt, Homo sapiens
gcuucacaaaucggagggguac

SEQ ID NO: 7043 - RNA, 22 nt, Homo sapiens
cuucacaaaucggagggguaca

SEQ ID NO: 7044 - RNA, 22 nt, Homo sapiens
uucacaaaucggagggguacau

SEQ ID NO: 7045 - RNA, 22 nt, Homo sapiens
ucacaaaucggagggguacaua

SEQ ID NO: 7046 - RNA, 22 nt, Homo sapiens
cacaaaucggagggguacauag

SEQ ID NO: 7047 - RNA, 22 nt, Homo sapiens
acaaaucggagggguacauaga

SEQ ID NO: 7048 - RNA, 22 nt, Homo sapiens
caaaucggagggguacauagaa

SEQ ID NO: 7049 - RNA, 22 nt, Homo sapiens
aaaucggagggguacauagaau

SEQ ID NO: 7050 - RNA, 22 nt, Homo sapiens
aaucggagggguacauagaaug

SEQ ID NO: 7051 - RNA, 22 nt, Homo sapiens
aucggagggguacauagaaugu

SEQ ID NO: 7052 - RNA, 22 nt, Homo sapiens
ucggagggguacauagaaugug

SEQ ID NO: 7053 - RNA, 22 nt, Homo sapiens
cggagggguacauagaaugugc

SEQ ID NO: 7054 - RNA, 22 nt, Homo sapiens
ggagggguacauagaaugugca

SEQ ID NO: 7055 - RNA, 22 nt, Homo sapiens
gagggguacauagaaugugcaa

SEQ ID NO: 7056 - RNA, 22 nt, Homo sapiens
agggguacauagaaugugcaag

SEQ ID NO: 7057 - RNA, 22 nt, Homo sapiens
gggguacauagaaugugcaaga

SEQ ID NO: 7058 - RNA, 22 nt, Homo sapiens
ggguacauagaaugugcaagag

SEQ ID NO: 7059 - RNA, 22 nt, Homo sapiens
gguacauagaaugugcaagagu

SEQ ID NO: 7060 - RNA, 22 nt, Homo sapiens
guacauagaaugugcaagaguc

SEQ ID NO: 7061 - RNA, 22 nt, Homo sapiens
uacauagaaugugcaagaguca

SEQ ID NO: 7062 - RNA, 22 nt, Homo sapiens
acauagaaugugcaagagucaa

SEQ ID NO: 7063 - RNA, 22 nt, Homo sapiens
cauagaaugugcaagagucaaa

SEQ ID NO: 7064 - RNA, 22 nt, Homo sapiens
auagaaugugcaagagucaaag

SEQ ID NO: 7065 - RNA, 22 nt, Homo sapiens
uagaaugugcaagagucaaagg

SEQ ID NO: 7066 - RNA, 22 nt, Homo sapiens
agaaugugcaagagucaaagga

SEQ ID NO: 7067 - RNA, 22 nt, Homo sapiens
gaaugugcaagagucaaaggau

SEQ ID NO: 7068 - RNA, 22 nt, Homo sapiens
aaugugcaagagucaaaggaua

SEQ ID NO: 7069 - RNA, 22 nt, Homo sapiens
augugcaagagucaaaggauaa

SEQ ID NO: 7070 - RNA, 22 nt, Homo sapiens
ugugcaagagucaaaggauaaa

SEQ ID NO: 7071 - RNA, 22 nt, Homo sapiens
gugcaagagucaaaggauaaau

SEQ ID NO: 7072 - RNA, 22 nt, Homo sapiens
ugcaagagucaaaggauaaaua

SEQ ID NO: 7073 - RNA, 22 nt, Homo sapiens
gcaagagucaaaggauaaauaa

SEQ ID NO: 7074 - RNA, 22 nt, Homo sapiens
caagagucaaaggauaaauaau

SEQ ID NO: 7075 - RNA, 22 nt, Homo sapiens
aagagucaaaggauaaauaaua

SEQ ID NO: 7076 - RNA, 22 nt, Homo sapiens
agagucaaaggauaaauaauau

SEQ ID NO: 7077 - RNA, 22 nt, Homo sapiens
gagucaaaggauaaauaauauu

SEQ ID NO: 7078 - RNA, 22 nt, Homo sapiens
agucaaaggauaaauaauauua

SEQ ID NO: 7079 - RNA, 22 nt, Homo sapiens
gucaaaggauaaauaauauuau

SEQ ID NO: 7080 - RNA, 22 nt, Homo sapiens
ucaaaggauaaauaauauuaua

SEQ ID NO: 7081 - RNA, 22 nt, Homo sapiens
caaaggauaaauaauauuauaa

SEQ ID NO: 7082 - RNA, 22 nt, Homo sapiens
aaaggauaaauaauauuauaaa

SEQ ID NO: 7083 - RNA, 22 nt, Homo sapiens
aaggauaaauaauauuauaaau

SEQ ID NO: 7084 - RNA, 22 nt, Homo sapiens
aggauaaauaauauuauaaaua

SEQ ID NO: 7085 - RNA, 22 nt, Homo sapiens
ggauaaauaauauuauaaauau

SEQ ID NO: 7086 - RNA, 22 nt, Homo sapiens
gauaaauaauauuauaaauaua

SEQ ID NO: 7087 - RNA, 22 nt, Homo sapiens
auaaauaauauuauaaauauau

SEQ ID NO: 7088 - RNA, 22 nt, Homo sapiens
uaaauaauauuauaaauauaua

SEQ ID NO: 7089 - RNA, 22 nt, Homo sapiens
aaauaauauuauaaauauauau

SEQ ID NO: 7090 - RNA, 22 nt, Homo sapiens
aauaauauuauaaauauauauu

SEQ ID NO: 7091 - RNA, 22 nt, Homo sapiens
auaauauuauaaauauauauua

SEQ ID NO: 7092 - RNA, 22 nt, Homo sapiens
uaauauuauaaauauauauuaa

SEQ ID NO: 7093 - RNA, 22 nt, Homo sapiens
aauauuauaaauauauauuaac

SEQ ID NO: 7094 - RNA, 22 nt, Homo sapiens
auauuauaaauauauauuaacu

SEQ ID NO: 7095 - RNA, 22 nt, Homo sapiens
uauuauaaauauauauuaacua

SEQ ID NO: 7096 - RNA, 22 nt, Homo sapiens
auuauaaauauauauuaacuau

SEQ ID NO: 7097 - RNA, 22 nt, Homo sapiens
uuauaaauauauauuaacuaua

SEQ ID NO: 7098 - RNA, 22 nt, Homo sapiens
uauaaauauauauuaacuauau

SEQ ID NO: 7099 - RNA, 22 nt, Homo sapiens
auaaauauauauuaacuauauu

SEQ ID NO: 7100 - RNA, 22 nt, Homo sapiens
uaaauauauauuaacuauauua

SEQ ID NO: 7101 - RNA, 22 nt, Homo sapiens
aaauauauauuaacuauauuac

SEQ ID NO: 7102 - RNA, 22 nt, Homo sapiens
aauauauauuaacuauauuacc

SEQ ID NO: 7103 - RNA, 22 nt, Homo sapiens
auauauauuaacuauauuaccu

SEQ ID NO: 7104 - RNA, 22 nt, Homo sapiens
uauauauuaacuauauuaccua

SEQ ID NO: 7105 - RNA, 22 nt, Homo sapiens
auauauuaacuauauuaccuaa

SEQ ID NO: 7106 - RNA, 22 nt, Homo sapiens
uauauuaacuauauuaccuaau

SEQ ID NO: 7107 - RNA, 22 nt, Homo sapiens
auauuaacuauauuaccuaauu

SEQ ID NO: 7108 - RNA, 22 nt, Homo sapiens
uauuaacuauauuaccuaauua

SEQ ID NO: 7109 - RNA, 22 nt, Homo sapiens
auuaacuauauuaccuaauuaa

SEQ ID NO: 7110 - RNA, 22 nt, Homo sapiens
uuaacuauauuaccuaauuaaa

SEQ ID NO: 7111 - RNA, 22 nt, Homo sapiens
uaacuauauuaccuaauuaaaa

SEQ ID NO: 7112 - RNA, 22 nt, Homo sapiens
aacuauauuaccuaauuaaaac

SEQ ID NO: 7113 - RNA, 22 nt, Homo sapiens
acuauauuaccuaauuaaaacc

SEQ ID NO: 7114 - RNA, 22 nt, Homo sapiens
cuauauuaccuaauuaaaacca

SEQ ID NO: 7115 - RNA, 22 nt, Homo sapiens
uauauuaccuaauuaaaaccau

SEQ ID NO: 7116 - RNA, 22 nt, Homo sapiens
auauuaccuaauuaaaaccaua

SEQ ID NO: 7117 - RNA, 22 nt, Homo sapiens
uauuaccuaauuaaaaccauaa

SEQ ID NO: 7118 - RNA, 22 nt, Homo sapiens
auuaccuaauuaaaaccauaau

SEQ ID NO: 7119 - RNA, 22 nt, Homo sapiens
uuaccuaauuaaaaccauaauc

SEQ ID NO: 7120 - RNA, 22 nt, Homo sapiens
uaccuaauuaaaaccauaaucu

SEQ ID NO: 7121 - RNA, 22 nt, Homo sapiens
accuaauuaaaaccauaaucug

SEQ ID NO: 7122 - RNA, 22 nt, Homo sapiens
ccuaauuaaaaccauaaucugu

SEQ ID NO: 7123 - RNA, 22 nt, Homo sapiens
cuaauuaaaaccauaaucuguu

SEQ ID NO: 7124 - RNA, 22 nt, Homo sapiens
uaauuaaaaccauaaucuguua

SEQ ID NO: 7125 - RNA, 22 nt, Homo sapiens
aauuaaaaccauaaucuguuaa

SEQ ID NO: 7126 - RNA, 22 nt, Homo sapiens
auuaaaaccauaaucuguuaau

SEQ ID NO: 7127 - RNA, 22 nt, Homo sapiens
uuaaaaccauaaucuguuaaua

SEQ ID NO: 7128 - RNA, 22 nt, Homo sapiens
uaaaaccauaaucuguuaauac

SEQ ID NO: 7129 - RNA, 22 nt, Homo sapiens
aaaaccauaaucuguuaauaca

SEQ ID NO: 7130 - RNA, 22 nt, Homo sapiens
aaaccauaaucuguuaauacag

SEQ ID NO: 7131 - RNA, 22 nt, Homo sapiens
aaccauaaucuguuaauacagc

SEQ ID NO: 7132 - RNA, 22 nt, Homo sapiens
accauaaucuguuaauacagcu

SEQ ID NO: 7133 - RNA, 22 nt, Homo sapiens
ccauaaucuguuaauacagcua

SEQ ID NO: 7134 - RNA, 22 nt, Homo sapiens
cauaaucuguuaauacagcuau

SEQ ID NO: 7135 - RNA, 22 nt, Homo sapiens
auaaucuguuaauacagcuaug

SEQ ID NO: 7136 - RNA, 22 nt, Homo sapiens
uaaucuguuaauacagcuaugg

SEQ ID NO: 7137 - RNA, 22 nt, Homo sapiens
aaucuguuaauacagcuaugga

SEQ ID NO: 7138 - RNA, 22 nt, Homo sapiens
aucuguuaauacagcuauggau

SEQ ID NO: 7139 - RNA, 22 nt, Homo sapiens
ucuguuaauacagcuauggauu

SEQ ID NO: 7140 - RNA, 22 nt, Homo sapiens
cuguuaauacagcuauggauua

SEQ ID NO: 7141 - RNA, 22 nt, Homo sapiens
uguuaauacagcuauggauuaa

SEQ ID NO: 7142 - RNA, 22 nt, Homo sapiens
guuaauacagcuauggauuaau

SEQ ID NO: 7143 - RNA, 22 nt, Homo sapiens
uuaauacagcuauggauuaauu

SEQ ID NO: 7144 - RNA, 22 nt, Homo sapiens
uaauacagcuauggauuaauuu

SEQ ID NO: 7145 - RNA, 22 nt, Homo sapiens
aauacagcuauggauuaauuuc

SEQ ID NO: 7146 - RNA, 22 nt, Homo sapiens
auacagcuauggauuaauuuca

SEQ ID NO: 7147 - RNA, 22 nt, Homo sapiens
uacagcuauggauuaauuucaa

SEQ ID NO: 7148 - RNA, 22 nt, Homo sapiens
acagcuauggauuaauuucaaa

SEQ ID NO: 7149 - RNA, 22 nt, Homo sapiens
cagcuauggauuaauuucaaaa

SEQ ID NO: 7150 - RNA, 22 nt, Homo sapiens
agcuauggauuaauuucaaaaa

SEQ ID NO: 7151 - RNA, 22 nt, Homo sapiens
gcuauggauuaauuucaaaaaa

SEQ ID NO: 7152 - RNA, 22 nt, Homo sapiens
cuauggauuaauuucaaaaaaa

SEQ ID NO: 7153 - RNA, 22 nt, Homo sapiens
uauggauuaauuucaaaaaaau

SEQ ID NO: 7154 - RNA, 22 nt, Homo sapiens
auggauuaauuucaaaaaaaug

SEQ ID NO: 7155 - RNA, 22 nt, Homo sapiens
uggauuaauuucaaaaaaaugu

SEQ ID NO: 7156 - RNA, 22 nt, Homo sapiens
ggauuaauuucaaaaaaaugua

SEQ ID NO: 7157 - RNA, 22 nt, Homo sapiens
gauuaauuucaaaaaaauguaa

SEQ ID NO: 7158 - RNA, 22 nt, Homo sapiens
auuaauuucaaaaaaauguaau

SEQ ID NO: 7159 - RNA, 22 nt, Homo sapiens
uuaauuucaaaaaaauguaauc

SEQ ID NO: 7160 - RNA, 22 nt, Homo sapiens
uaauuucaaaaaaauguaauca

SEQ ID NO: 7161 - RNA, 22 nt, Homo sapiens
aauuucaaaaaaauguaaucaa

SEQ ID NO: 7162 - RNA, 22 nt, Homo sapiens
auuucaaaaaaauguaaucaaa

SEQ ID NO: 7163 - RNA, 22 nt, Homo sapiens
uuucaaaaaaauguaaucaaau

SEQ ID NO: 7164 - RNA, 22 nt, Homo sapiens
uucaaaaaaauguaaucaaaua

SEQ ID NO: 7165 - RNA, 22 nt, Homo sapiens
ucaaaaaaauguaaucaaauau

SEQ ID NO: 7166 - RNA, 22 nt, Homo sapiens
caaaaaaauguaaucaaauaua

SEQ ID NO: 7167 - RNA, 22 nt, Homo sapiens
aaaaaaauguaaucaaauauau

SEQ ID NO: 7168 - RNA, 22 nt, Homo sapiens
aaaaaauguaaucaaauauauu

SEQ ID NO: 7169 - RNA, 22 nt, Homo sapiens
aaaaauguaaucaaauauauua

SEQ ID NO: 7170 - RNA, 22 nt, Homo sapiens
aaaauguaaucaaauauauuac

SEQ ID NO: 7171 - RNA, 22 nt, Homo sapiens
aaauguaaucaaauauauuacu

SEQ ID NO: 7172 - RNA, 22 nt, Homo sapiens
aauguaaucaaauauauuacua

SEQ ID NO: 7173 - RNA, 22 nt, Homo sapiens
auguaaucaaauauauuacuaa

SEQ ID NO: 7174 - RNA, 22 nt, Homo sapiens
uguaaucaaauauauuacuaau

SEQ ID NO: 7175 - RNA, 22 nt, Homo sapiens
guaaucaaauauauuacuaaug

SEQ ID NO: 7176 - RNA, 22 nt, Homo sapiens
uaaucaaauauauuacuaaugg

SEQ ID NO: 7177 - RNA, 22 nt, Homo sapiens
aaucaaauauauuacuaauggu

SEQ ID NO: 7178 - RNA, 22 nt, Homo sapiens
aucaaauauauuacuaauggug

SEQ ID NO: 7179 - RNA, 22 nt, Homo sapiens
ucaaauauauuacuaauggugu

SEQ ID NO: 7180 - RNA, 22 nt, Homo sapiens
caaauauauuacuaauggugua

SEQ ID NO: 7181 - RNA, 22 nt, Homo sapiens
aaauauauuacuaaugguguag

SEQ ID NO: 7182 - RNA, 22 nt, Homo sapiens
aauauauuacuaaugguguagu

SEQ ID NO: 7183 - RNA, 22 nt, Homo sapiens
auauauuacuaaugguguaguu

SEQ ID NO: 7184 - RNA, 22 nt, Homo sapiens
uauauuacuaaugguguaguug

SEQ ID NO: 7185 - RNA, 22 nt, Homo sapiens
auauuacuaaugguguaguugg

SEQ ID NO: 7186 - RNA, 22 nt, Homo sapiens
uauuacuaaugguguaguuggc

SEQ ID NO: 7187 - RNA, 22 nt, Homo sapiens
auuacuaaugguguaguuggcu

SEQ ID NO: 7188 - RNA, 22 nt, Homo sapiens
uuacuaaugguguaguuggcug

SEQ ID NO: 7189 - RNA, 22 nt, Homo sapiens
uacuaaugguguaguuggcugu

SEQ ID NO: 7190 - RNA, 22 nt, Homo sapiens
acuaaugguguaguuggcuguu

SEQ ID NO: 7191 - RNA, 22 nt, Homo sapiens
cuaaugguguaguuggcuguuu

SEQ ID NO: 7192 - RNA, 22 nt, Homo sapiens
uaaugguguaguuggcuguuuu

SEQ ID NO: 7193 - RNA, 22 nt, Homo sapiens
aaugguguaguuggcuguuuuc

SEQ ID NO: 7194 - RNA, 22 nt, Homo sapiens
augguguaguuggcuguuuucc

SEQ ID NO: 7195 - RNA, 22 nt, Homo sapiens
ugguguaguuggcuguuuucca

SEQ ID NO: 7196 - RNA, 22 nt, Homo sapiens
gguguaguuggcuguuuuccaa

SEQ ID NO: 7197 - RNA, 22 nt, Homo sapiens
guguaguuggcuguuuuccaau

SEQ ID NO: 7198 - RNA, 22 nt, Homo sapiens
uguaguuggcuguuuuccaaug

SEQ ID NO: 7199 - RNA, 22 nt, Homo sapiens
guaguuggcuguuuuccaaugu

SEQ ID NO: 7200 - RNA, 22 nt, Homo sapiens
uaguuggcuguuuuccaauguu

SEQ ID NO: 7201 - RNA, 22 nt, Homo sapiens
aguuggcuguuuuccaauguug

SEQ ID NO: 7202 - RNA, 22 nt, Homo sapiens
guuggcuguuuuccaauguugg

SEQ ID NO: 7203 - RNA, 22 nt, Homo sapiens
uuggcuguuuuccaauguuggu

SEQ ID NO: 7204 - RNA, 22 nt, Homo sapiens
uggcuguuuuccaauguuggua

SEQ ID NO: 7205 - RNA, 22 nt, Homo sapiens
ggcuguuuuccaauguugguaa

SEQ ID NO: 7206 - RNA, 22 nt, Homo sapiens
gcuguuuuccaauguugguaaa

SEQ ID NO: 7207 - RNA, 22 nt, Homo sapiens
cuguuuuccaauguugguaaag

SEQ ID NO: 7208 - RNA, 22 nt, Homo sapiens
uguuuuccaauguugguaaagu

SEQ ID NO: 7209 - RNA, 22 nt, Homo sapiens
guuuuccaauguugguaaaguu

SEQ ID NO: 7210 - RNA, 22 nt, Homo sapiens
uuuuccaauguugguaaaguua

SEQ ID NO: 7211 - RNA, 22 nt, Homo sapiens
uuuccaauguugguaaaguuau

SEQ ID NO: 7212 - RNA, 22 nt, Homo sapiens
uuccaauguugguaaaguuauu

SEQ ID NO: 7213 - RNA, 22 nt, Homo sapiens
uccaauguugguaaaguuauua

SEQ ID NO: 7214 - RNA, 22 nt, Homo sapiens
ccaauguugguaaaguuauuaa

SEQ ID NO: 7215 - RNA, 22 nt, Homo sapiens
caauguugguaaaguuauuaaa

SEQ ID NO: 7216 - RNA, 22 nt, Homo sapiens
aauguugguaaaguuauuaaag

SEQ ID NO: 7217 - RNA, 22 nt, Homo sapiens
auguugguaaaguuauuaaagu

SEQ ID NO: 7218 - RNA, 22 nt, Homo sapiens
uguugguaaaguuauuaaaguu

SEQ ID NO: 7219 - RNA, 22 nt, Homo sapiens
guugguaaaguuauuaaaguuc

SEQ ID NO: 7220 - RNA, 22 nt, Homo sapiens
uugguaaaguuauuaaaguucu

SEQ ID NO: 7221 - RNA, 22 nt, Homo sapiens
ugguaaaguuauuaaaguucuu

SEQ ID NO: 7222 - RNA, 22 nt, Homo sapiens
gguaaaguuauuaaaguucuuc

SEQ ID NO: 7223 - RNA, 22 nt, Homo sapiens
guaaaguuauuaaaguucuuca

SEQ ID NO: 7224 - RNA, 22 nt, Homo sapiens
uaaaguuauuaaaguucuucac

SEQ ID NO: 7225 - RNA, 22 nt, Homo sapiens
aaaguuauuaaaguucuucacu

SEQ ID NO: 7226 - RNA, 22 nt, Homo sapiens
aaguuauuaaaguucuucacuu

SEQ ID NO: 7227 - RNA, 22 nt, Homo sapiens
aguuauuaaaguucuucacuuu

SEQ ID NO: 7228 - RNA, 22 nt, Homo sapiens
guuauuaaaguucuucacuuuc

SEQ ID NO: 7229 - RNA, 22 nt, Homo sapiens
uuauuaaaguucuucacuuuca

SEQ ID NO: 7230 - RNA, 22 nt, Homo sapiens
uauuaaaguucuucacuuucau

SEQ ID NO: 7231 - RNA, 22 nt, Homo sapiens
auuaaaguucuucacuuucaua

SEQ ID NO: 7232 - RNA, 22 nt, Homo sapiens
uuaaaguucuucacuuucauag

SEQ ID NO: 7233 - RNA, 22 nt, Homo sapiens
uaaaguucuucacuuucauaga

SEQ ID NO: 7234 - RNA, 22 nt, Homo sapiens
aaaguucuucacuuucauagag

SEQ ID NO: 7235 - RNA, 22 nt, Homo sapiens
aaguucuucacuuucauagagu

SEQ ID NO: 7236 - RNA, 22 nt, Homo sapiens
aguucuucacuuucauagaguc

SEQ ID NO: 7237 - RNA, 22 nt, Homo sapiens
guucuucacuuucauagagucc

SEQ ID NO: 7238 - RNA, 22 nt, Homo sapiens
uucuucacuuucauagagucca

SEQ ID NO: 7239 - RNA, 22 nt, Homo sapiens
ucuucacuuucauagaguccag

SEQ ID NO: 7240 - RNA, 22 nt, Homo sapiens
cuucacuuucauagaguccaga

SEQ ID NO: 7241 - RNA, 22 nt, Homo sapiens
uucacuuucauagaguccagau

SEQ ID NO: 7242 - RNA, 22 nt, Homo sapiens
ucacuuucauagaguccagauu

SEQ ID NO: 7243 - RNA, 22 nt, Homo sapiens
cacuuucauagaguccagauug

SEQ ID NO: 7244 - RNA, 22 nt, Homo sapiens
acuuucauagaguccagauuga

SEQ ID NO: 7245 - RNA, 22 nt, Homo sapiens
cuuucauagaguccagauugag

SEQ ID NO: 7246 - RNA, 22 nt, Homo sapiens
uuucauagaguccagauugagc

SEQ ID NO: 7247 - RNA, 22 nt, Homo sapiens
uucauagaguccagauugagcu

SEQ ID NO: 7248 - RNA, 22 nt, Homo sapiens
ucauagaguccagauugagcug

SEQ ID NO: 7249 - RNA, 22 nt, Homo sapiens
cauagaguccagauugagcugc

SEQ ID NO: 7250 - RNA, 22 nt, Homo sapiens
auagaguccagauugagcugcc

SEQ ID NO: 7251 - RNA, 22 nt, Homo sapiens
uagaguccagauugagcugcca

SEQ ID NO: 7252 - RNA, 22 nt, Homo sapiens
agaguccagauugagcugccaa

SEQ ID NO: 7253 - RNA, 22 nt, Homo sapiens
gaguccagauugagcugccaaa

SEQ ID NO: 7254 - RNA, 22 nt, Homo sapiens
aguccagauugagcugccaaac

SEQ ID NO: 7255 - RNA, 22 nt, Homo sapiens
guccagauugagcugccaaacg

SEQ ID NO: 7256 - RNA, 22 nt, Homo sapiens
uccagauugagcugccaaacgc

SEQ ID NO: 7257 - RNA, 22 nt, Homo sapiens
ccagauugagcugccaaacgcu

SEQ ID NO: 7258 - RNA, 22 nt, Homo sapiens
cagauugagcugccaaacgcug

SEQ ID NO: 7259 - RNA, 22 nt, Homo sapiens
agauugagcugccaaacgcuga

SEQ ID NO: 7260 - RNA, 22 nt, Homo sapiens
gauugagcugccaaacgcugaa

SEQ ID NO: 7261 - RNA, 22 nt, Homo sapiens
auugagcugccaaacgcugaaa

SEQ ID NO: 7262 - RNA, 22 nt, Homo sapiens
uugagcugccaaacgcugaaau

SEQ ID NO: 7263 - RNA, 22 nt, Homo sapiens
ugagcugccaaacgcugaaauu

SEQ ID NO: 7264 - RNA, 22 nt, Homo sapiens
gagcugccaaacgcugaaauuc

SEQ ID NO: 7265 - RNA, 22 nt, Homo sapiens
agcugccaaacgcugaaauucu

SEQ ID NO: 7266 - RNA, 22 nt, Homo sapiens
gcugccaaacgcugaaauucuc

SEQ ID NO: 7267 - RNA, 22 nt, Homo sapiens
cugccaaacgcugaaauucucc

SEQ ID NO: 7268 - RNA, 22 nt, Homo sapiens
ugccaaacgcugaaauucuccu

SEQ ID NO: 7269 - RNA, 22 nt, Homo sapiens
gccaaacgcugaaauucuccuu

SEQ ID NO: 7270 - RNA, 22 nt, Homo sapiens
ccaaacgcugaaauucuccuuc

SEQ ID NO: 7271 - RNA, 22 nt, Homo sapiens
caaacgcugaaauucuccuucu

SEQ ID NO: 7272 - RNA, 22 nt, Homo sapiens
aaacgcugaaauucuccuucug

SEQ ID NO: 7273 - RNA, 22 nt, Homo sapiens
aacgcugaaauucuccuucugg

SEQ ID NO: 7274 - RNA, 22 nt, Homo sapiens
acgcugaaauucuccuucuggg

SEQ ID NO: 7275 - RNA, 22 nt, Homo sapiens
cgcugaaauucuccuucugggu

SEQ ID NO: 7276 - RNA, 22 nt, Homo sapiens
gcugaaauucuccuucuggguu

SEQ ID NO: 7277 - RNA, 22 nt, Homo sapiens
cugaaauucuccuucuggguua

SEQ ID NO: 7278 - RNA, 22 nt, Homo sapiens
ugaaauucuccuucuggguuaa

SEQ ID NO: 7279 - RNA, 22 nt, Homo sapiens
gaaauucuccuucuggguuaaa

SEQ ID NO: 7280 - RNA, 22 nt, Homo sapiens
aaauucuccuucuggguuaaaa

SEQ ID NO: 7281 - RNA, 22 nt, Homo sapiens
aauucuccuucuggguuaaaag

SEQ ID NO: 7282 - RNA, 22 nt, Homo sapiens
auucuccuucuggguuaaaagc

SEQ ID NO: 7283 - RNA, 22 nt, Homo sapiens
uucuccuucuggguuaaaagcu

SEQ ID NO: 7284 - RNA, 22 nt, Homo sapiens
ucuccuucuggguuaaaagcuu

SEQ ID NO: 7285 - RNA, 22 nt, Homo sapiens
cuccuucuggguuaaaagcuug

SEQ ID NO: 7286 - RNA, 22 nt, Homo sapiens
uccuucuggguuaaaagcuugu

SEQ ID NO: 7287 - RNA, 22 nt, Homo sapiens
ccuucuggguuaaaagcuuguu

SEQ ID NO: 7288 - RNA, 22 nt, Homo sapiens
cuucuggguuaaaagcuuguuu

SEQ ID NO: 7289 - RNA, 22 nt, Homo sapiens
uucuggguuaaaagcuuguuuu

SEQ ID NO: 7290 - RNA, 22 nt, Homo sapiens
ucuggguuaaaagcuuguuuua

SEQ ID NO: 7291 - RNA, 22 nt, Homo sapiens
cuggguuaaaagcuuguuuuac

SEQ ID NO: 7292 - RNA, 22 nt, Homo sapiens
uggguuaaaagcuuguuuuaca

SEQ ID NO: 7293 - RNA, 22 nt, Homo sapiens
ggguuaaaagcuuguuuuacau

SEQ ID NO: 7294 - RNA, 22 nt, Homo sapiens
gguuaaaagcuuguuuuacauu

SEQ ID NO: 7295 - RNA, 22 nt, Homo sapiens
guuaaaagcuuguuuuacauuc

SEQ ID NO: 7296 - RNA, 22 nt, Homo sapiens
uuaaaagcuuguuuuacauuca

SEQ ID NO: 7297 - RNA, 22 nt, Homo sapiens
uaaaagcuuguuuuacauucaa

SEQ ID NO: 7298 - RNA, 22 nt, Homo sapiens
aaaagcuuguuuuacauucaaa

SEQ ID NO: 7299 - RNA, 22 nt, Homo sapiens
aaagcuuguuuuacauucaaac

SEQ ID NO: 7300 - RNA, 22 nt, Homo sapiens
aagcuuguuuuacauucaaacc

SEQ ID NO: 7301 - RNA, 22 nt, Homo sapiens
agcuuguuuuacauucaaaccu

SEQ ID NO: 7302 - RNA, 22 nt, Homo sapiens
gcuuguuuuacauucaaaccuu

SEQ ID NO: 7303 - RNA, 22 nt, Homo sapiens
cuuguuuuacauucaaaccuuu

SEQ ID NO: 7304 - RNA, 22 nt, Homo sapiens
uuguuuuacauucaaaccuuuc

SEQ ID NO: 7305 - RNA, 22 nt, Homo sapiens
uguuuuacauucaaaccuuucc

SEQ ID NO: 7306 - RNA, 22 nt, Homo sapiens
guuuuacauucaaaccuuuccc

SEQ ID NO: 7307 - RNA, 22 nt, Homo sapiens
uuuuacauucaaaccuuuccca

SEQ ID NO: 7308 - RNA, 22 nt, Homo sapiens
uuuacauucaaaccuuucccau

SEQ ID NO: 7309 - RNA, 22 nt, Homo sapiens
uuacauucaaaccuuucccauu

SEQ ID NO: 7310 - RNA, 22 nt, Homo sapiens
uacauucaaaccuuucccauua

SEQ ID NO: 7311 - RNA, 22 nt, Homo sapiens
acauucaaaccuuucccauuaa

SEQ ID NO: 7312 - RNA, 22 nt, Homo sapiens
cauucaaaccuuucccauuaag

SEQ ID NO: 7313 - RNA, 22 nt, Homo sapiens
auucaaaccuuucccauuaagu

SEQ ID NO: 7314 - RNA, 22 nt, Homo sapiens
uucaaaccuuucccauuaagug

SEQ ID NO: 7315 - RNA, 22 nt, Homo sapiens
ucaaaccuuucccauuaagugc

SEQ ID NO: 7316 - RNA, 22 nt, Homo sapiens
caaaccuuucccauuaagugcu

SEQ ID NO: 7317 - RNA, 22 nt, Homo sapiens
aaaccuuucccauuaagugcua

SEQ ID NO: 7318 - RNA, 22 nt, Homo sapiens
aaccuuucccauuaagugcuaa

SEQ ID NO: 7319 - RNA, 22 nt, Homo sapiens
accuuucccauuaagugcuaaa

SEQ ID NO: 7320 - RNA, 22 nt, Homo sapiens
ccuuucccauuaagugcuaaau

SEQ ID NO: 7321 - RNA, 22 nt, Homo sapiens
cuuucccauuaagugcuaaaua

SEQ ID NO: 7322 - RNA, 22 nt, Homo sapiens
uuucccauuaagugcuaaauau

SEQ ID NO: 7323 - RNA, 22 nt, Homo sapiens
uucccauuaagugcuaaauauu

SEQ ID NO: 7324 - RNA, 22 nt, Homo sapiens
ucccauuaagugcuaaauauuu

SEQ ID NO: 7325 - RNA, 22 nt, Homo sapiens
cccauuaagugcuaaauauuug

SEQ ID NO: 7326 - RNA, 22 nt, Homo sapiens
ccauuaagugcuaaauauuugc

SEQ ID NO: 7327 - RNA, 22 nt, Homo sapiens
cauuaagugcuaaauauuugcu

SEQ ID NO: 7328 - RNA, 22 nt, Homo sapiens
auuaagugcuaaauauuugcug

SEQ ID NO: 7329 - RNA, 22 nt, Homo sapiens
uuaagugcuaaauauuugcuga

SEQ ID NO: 7330 - RNA, 22 nt, Homo sapiens
uaagugcuaaauauuugcugaa

SEQ ID NO: 7331 - RNA, 22 nt, Homo sapiens
aagugcuaaauauuugcugaau

SEQ ID NO: 7332 - RNA, 22 nt, Homo sapiens
agugcuaaauauuugcugaaug

SEQ ID NO: 7333 - RNA, 22 nt, Homo sapiens
gugcuaaauauuugcugaaugu

SEQ ID NO: 7334 - RNA, 22 nt, Homo sapiens
ugcuaaauauuugcugaauguu

SEQ ID NO: 7335 - RNA, 22 nt, Homo sapiens
gcuaaauauuugcugaauguug

SEQ ID NO: 7336 - RNA, 22 nt, Homo sapiens
cuaaauauuugcugaauguugg

SEQ ID NO: 7337 - RNA, 22 nt, Homo sapiens
uaaauauuugcugaauguuggu

SEQ ID NO: 7338 - RNA, 22 nt, Homo sapiens
aaauauuugcugaauguugguc

SEQ ID NO: 7339 - RNA, 22 nt, Homo sapiens
aauauuugcugaauguuggucg

SEQ ID NO: 7340 - RNA, 22 nt, Homo sapiens
auauuugcugaauguuggucga

SEQ ID NO: 7341 - RNA, 22 nt, Homo sapiens
uauuugcugaauguuggucgaa

SEQ ID NO: 7342 - RNA, 22 nt, Homo sapiens
auuugcugaauguuggucgaac

SEQ ID NO: 7343 - RNA, 22 nt, Homo sapiens
uuugcugaauguuggucgaacc

SEQ ID NO: 7344 - RNA, 22 nt, Homo sapiens
uugcugaauguuggucgaaccc

SEQ ID NO: 7345 - RNA, 22 nt, Homo sapiens
ugcugaauguuggucgaacccg

SEQ ID NO: 7346 - RNA, 22 nt, Homo sapiens
gcugaauguuggucgaacccgu

SEQ ID NO: 7347 - RNA, 22 nt, Homo sapiens
cugaauguuggucgaacccgua

SEQ ID NO: 7348 - RNA, 22 nt, Homo sapiens
ugaauguuggucgaacccguaa

SEQ ID NO: 7349 - RNA, 22 nt, Homo sapiens
gaauguuggucgaacccguaac

SEQ ID NO: 7350 - RNA, 22 nt, Homo sapiens
aauguuggucgaacccguaacu

SEQ ID NO: 7351 - RNA, 22 nt, Homo sapiens
auguuggucgaacccguaacug

SEQ ID NO: 7352 - RNA, 22 nt, Homo sapiens
uguuggucgaacccguaacugc

SEQ ID NO: 7353 - RNA, 22 nt, Homo sapiens
guuggucgaacccguaacugcu

SEQ ID NO: 7354 - RNA, 22 nt, Homo sapiens
uuggucgaacccguaacugcuu

SEQ ID NO: 7355 - RNA, 22 nt, Homo sapiens
uggucgaacccguaacugcuua

SEQ ID NO: 7356 - RNA, 22 nt, Homo sapiens
ggucgaacccguaacugcuuag

SEQ ID NO: 7357 - RNA, 22 nt, Homo sapiens
gucgaacccguaacugcuuagg

SEQ ID NO: 7358 - RNA, 22 nt, Homo sapiens
ucgaacccguaacugcuuagga

SEQ ID NO: 7359 - RNA, 22 nt, Homo sapiens
cgaacccguaacugcuuaggag

SEQ ID NO: 7360 - RNA, 22 nt, Homo sapiens
gaacccguaacugcuuaggagc

SEQ ID NO: 7361 - RNA, 22 nt, Homo sapiens
aacccguaacugcuuaggagcu

SEQ ID NO: 7362 - RNA, 22 nt, Homo sapiens
acccguaacugcuuaggagcug

SEQ ID NO: 7363 - RNA, 22 nt, Homo sapiens
cccguaacugcuuaggagcugg

SEQ ID NO: 7364 - RNA, 22 nt, Homo sapiens
ccguaacugcuuaggagcugga

SEQ ID NO: 7365 - RNA, 22 nt, Homo sapiens
cguaacugcuuaggagcuggaa

SEQ ID NO: 7366 - RNA, 22 nt, Homo sapiens
guaacugcuuaggagcuggaag

SEQ ID NO: 7367 - RNA, 22 nt, Homo sapiens
uaacugcuuaggagcuggaaga

SEQ ID NO: 7368 - RNA, 22 nt, Homo sapiens
aacugcuuaggagcuggaagag

SEQ ID NO: 7369 - RNA, 22 nt, Homo sapiens
acugcuuaggagcuggaagagu

SEQ ID NO: 7370 - RNA, 22 nt, Homo sapiens
cugcuuaggagcuggaagaguu

SEQ ID NO: 7371 - RNA, 22 nt, Homo sapiens
ugcuuaggagcuggaagaguuu

SEQ ID NO: 7372 - RNA, 22 nt, Homo sapiens
gcuuaggagcuggaagaguuug

SEQ ID NO: 7373 - RNA, 22 nt, Homo sapiens
cuuaggagcuggaagaguuugg

SEQ ID NO: 7374 - RNA, 22 nt, Homo sapiens
uuaggagcuggaagaguuuggu

SEQ ID NO: 7375 - RNA, 22 nt, Homo sapiens
uaggagcuggaagaguuugguu

SEQ ID NO: 7376 - RNA, 22 nt, Homo sapiens
aggagcuggaagaguuugguuu

SEQ ID NO: 7377 - RNA, 22 nt, Homo sapiens
ggagcuggaagaguuugguuug

SEQ ID NO: 7378 - RNA, 22 nt, Homo sapiens
gagcuggaagaguuugguuugg

SEQ ID NO: 7379 - RNA, 22 nt, Homo sapiens
agcuggaagaguuugguuugga

SEQ ID NO: 7380 - RNA, 22 nt, Homo sapiens
gcuggaagaguuugguuuggac

SEQ ID NO: 7381 - RNA, 22 nt, Homo sapiens
cuggaagaguuugguuuggacg

SEQ ID NO: 7382 - RNA, 22 nt, Homo sapiens
uggaagaguuugguuuggacgu

SEQ ID NO: 7383 - RNA, 22 nt, Homo sapiens
ggaagaguuugguuuggacgug

SEQ ID NO: 7384 - RNA, 22 nt, Homo sapiens
gaagaguuugguuuggacgugc

SEQ ID NO: 7385 - RNA, 22 nt, Homo sapiens
aagaguuugguuuggacgugcc

SEQ ID NO: 7386 - RNA, 22 nt, Homo sapiens
agaguuugguuuggacgugccg

SEQ ID NO: 7387 - RNA, 22 nt, Homo sapiens
gaguuugguuuggacgugccgu

SEQ ID NO: 7388 - RNA, 22 nt, Homo sapiens
aguuugguuuggacgugccgua

SEQ ID NO: 7389 - RNA, 22 nt, Homo sapiens
guuugguuuggacgugccguaa

SEQ ID NO: 7390 - RNA, 22 nt, Homo sapiens
uuugguuuggacgugccguaac

SEQ ID NO: 7391 - RNA, 22 nt, Homo sapiens
uugguuuggacgugccguaacg

SEQ ID NO: 7392 - RNA, 22 nt, Homo sapiens
ugguuuggacgugccguaacgu

SEQ ID NO: 7393 - RNA, 22 nt, Homo sapiens
gguuuggacgugccguaacguc

SEQ ID NO: 7394 - RNA, 22 nt, Homo sapiens
guuuggacgugccguaacgucu

SEQ ID NO: 7395 - RNA, 22 nt, Homo sapiens
uuuggacgugccguaacgucua

SEQ ID NO: 7396 - RNA, 22 nt, Homo sapiens
uuggacgugccguaacgucuaa

SEQ ID NO: 7397 - RNA, 22 nt, Homo sapiens
uggacgugccguaacgucuaau

SEQ ID NO: 7398 - RNA, 22 nt, Homo sapiens
ggacgugccguaacgucuaauc

SEQ ID NO: 7399 - RNA, 22 nt, Homo sapiens
gacgugccguaacgucuaaucu

SEQ ID NO: 7400 - RNA, 22 nt, Homo sapiens
acgugccguaacgucuaaucuu

SEQ ID NO: 7401 - RNA, 22 nt, Homo sapiens
cgugccguaacgucuaaucuug

SEQ ID NO: 7402 - RNA, 22 nt, Homo sapiens
gugccguaacgucuaaucuugu

SEQ ID NO: 7403 - RNA, 22 nt, Homo sapiens
ugccguaacgucuaaucuugug

SEQ ID NO: 7404 - RNA, 22 nt, Homo sapiens
gccguaacgucuaaucuugugu

SEQ ID NO: 7405 - RNA, 22 nt, Homo sapiens
ccguaacgucuaaucuuguguu

SEQ ID NO: 7406 - RNA, 22 nt, Homo sapiens
cguaacgucuaaucuuguguua

SEQ ID NO: 7407 - RNA, 22 nt, Homo sapiens
guaacgucuaaucuuguguuac

SEQ ID NO: 7408 - RNA, 22 nt, Homo sapiens
uaacgucuaaucuuguguuaca

SEQ ID NO: 7409 - RNA, 22 nt, Homo sapiens
aacgucuaaucuuguguuacau

SEQ ID NO: 7410 - RNA, 22 nt, Homo sapiens
acgucuaaucuuguguuacaug

SEQ ID NO: 7411 - RNA, 22 nt, Homo sapiens
cgucuaaucuuguguuacaugu

SEQ ID NO: 7412 - RNA, 22 nt, Homo sapiens
gucuaaucuuguguuacaugua

SEQ ID NO: 7413 - RNA, 22 nt, Homo sapiens
ucuaaucuuguguuacauguag

SEQ ID NO: 7414 - RNA, 22 nt, Homo sapiens
cuaaucuuguguuacauguagu

SEQ ID NO: 7415 - RNA, 22 nt, Homo sapiens
uaaucuuguguuacauguaguc

SEQ ID NO: 7416 - RNA, 22 nt, Homo sapiens
aaucuuguguuacauguaguca

SEQ ID NO: 7417 - RNA, 22 nt, Homo sapiens
aucuuguguuacauguagucac

SEQ ID NO: 7418 - RNA, 22 nt, Homo sapiens
ucuuguguuacauguagucacu

SEQ ID NO: 7419 - RNA, 22 nt, Homo sapiens
cuuguguuacauguagucacuc

SEQ ID NO: 7420 - RNA, 22 nt, Homo sapiens
uuguguuacauguagucacucc

SEQ ID NO: 7421 - RNA, 22 nt, Homo sapiens
uguguuacauguagucacucca

SEQ ID NO: 7422 - RNA, 22 nt, Homo sapiens
guguuacauguagucacuccag

SEQ ID NO: 7423 - RNA, 22 nt, Homo sapiens
uguuacauguagucacuccagc

SEQ ID NO: 7424 - RNA, 22 nt, Homo sapiens
guuacauguagucacuccagcu

SEQ ID NO: 7425 - RNA, 22 nt, Homo sapiens
uuacauguagucacuccagcuu

SEQ ID NO: 7426 - RNA, 22 nt, Homo sapiens
uacauguagucacuccagcuuc

SEQ ID NO: 7427 - RNA, 22 nt, Homo sapiens
acauguagucacuccagcuuca

SEQ ID NO: 7428 - RNA, 22 nt, Homo sapiens
cauguagucacuccagcuucau

SEQ ID NO: 7429 - RNA, 22 nt, Homo sapiens
auguagucacuccagcuucauu

SEQ ID NO: 7430 - RNA, 22 nt, Homo sapiens
uguagucacuccagcuucauua

SEQ ID NO: 7431 - RNA, 22 nt, Homo sapiens
guagucacuccagcuucauuaa

SEQ ID NO: 7432 - RNA, 22 nt, Homo sapiens
uagucacuccagcuucauuaac

SEQ ID NO: 7433 - RNA, 22 nt, Homo sapiens
agucacuccagcuucauuaacu

SEQ ID NO: 7434 - RNA, 22 nt, Homo sapiens
gucacuccagcuucauuaacug

SEQ ID NO: 7435 - RNA, 22 nt, Homo sapiens
ucacuccagcuucauuaacugc

SEQ ID NO: 7436 - RNA, 22 nt, Homo sapiens
cacuccagcuucauuaacugcu

SEQ ID NO: 7437 - RNA, 22 nt, Homo sapiens
acuccagcuucauuaacugcug

SEQ ID NO: 7438 - RNA, 22 nt, Homo sapiens
cuccagcuucauuaacugcuga

SEQ ID NO: 7439 - RNA, 22 nt, Homo sapiens
uccagcuucauuaacugcugac

SEQ ID NO: 7440 - RNA, 22 nt, Homo sapiens
ccagcuucauuaacugcugaca

SEQ ID NO: 7441 - RNA, 22 nt, Homo sapiens
cagcuucauuaacugcugacac

SEQ ID NO: 7442 - RNA, 22 nt, Homo sapiens
agcuucauuaacugcugacaca

SEQ ID NO: 7443 - RNA, 22 nt, Homo sapiens
gcuucauuaacugcugacacag

SEQ ID NO: 7444 - RNA, 22 nt, Homo sapiens
cuucauuaacugcugacacagu

SEQ ID NO: 7445 - RNA, 22 nt, Homo sapiens
uucauuaacugcugacacagua

SEQ ID NO: 7446 - RNA, 22 nt, Homo sapiens
ucauuaacugcugacacaguau

SEQ ID NO: 7447 - RNA, 22 nt, Homo sapiens
cauuaacugcugacacaguaua

SEQ ID NO: 7448 - RNA, 22 nt, Homo sapiens
auuaacugcugacacaguauac

SEQ ID NO: 7449 - RNA, 22 nt, Homo sapiens
uuaacugcugacacaguauacc

SEQ ID NO: 7450 - RNA, 22 nt, Homo sapiens
uaacugcugacacaguauacca

SEQ ID NO: 7451 - RNA, 22 nt, Homo sapiens
aacugcugacacaguauaccac

SEQ ID NO: 7452 - RNA, 22 nt, Homo sapiens
acugcugacacaguauaccacc

SEQ ID NO: 7453 - RNA, 22 nt, Homo sapiens
cugcugacacaguauaccaccc

SEQ ID NO: 7454 - RNA, 22 nt, Homo sapiens
ugcugacacaguauaccaccca

SEQ ID NO: 7455 - RNA, 22 nt, Homo sapiens
gcugacacaguauaccacccag

SEQ ID NO: 7456 - RNA, 22 nt, Homo sapiens
cugacacaguauaccacccagc

SEQ ID NO: 7457 - RNA, 22 nt, Homo sapiens
ugacacaguauaccacccagca

SEQ ID NO: 7458 - RNA, 22 nt, Homo sapiens
gacacaguauaccacccagcau

SEQ ID NO: 7459 - RNA, 22 nt, Homo sapiens
acacaguauaccacccagcauc

SEQ ID NO: 7460 - RNA, 22 nt, Homo sapiens
cacaguauaccacccagcaucu

SEQ ID NO: 7461 - RNA, 22 nt, Homo sapiens
acaguauaccacccagcaucuu

SEQ ID NO: 7462 - RNA, 22 nt, Homo sapiens
caguauaccacccagcaucuuu

SEQ ID NO: 7463 - RNA, 22 nt, Homo sapiens
aguauaccacccagcaucuuuc

SEQ ID NO: 7464 - RNA, 22 nt, Homo sapiens
guauaccacccagcaucuuucu

SEQ ID NO: 7465 - RNA, 22 nt, Homo sapiens
uauaccacccagcaucuuucuu

SEQ ID NO: 7466 - RNA, 22 nt, Homo sapiens
auaccacccagcaucuuucuug

SEQ ID NO: 7467 - RNA, 22 nt, Homo sapiens
uaccacccagcaucuuucuugu

SEQ ID NO: 7468 - RNA, 22 nt, Homo sapiens
accacccagcaucuuucuuguu

SEQ ID NO: 7469 - RNA, 22 nt, Homo sapiens
ccacccagcaucuuucuuguuu

SEQ ID NO: 7470 - RNA, 22 nt, Homo sapiens
cacccagcaucuuucuuguuua

SEQ ID NO: 7471 - RNA, 22 nt, Homo sapiens
acccagcaucuuucuuguuuac

SEQ ID NO: 7472 - RNA, 22 nt, Homo sapiens
cccagcaucuuucuuguuuaca

SEQ ID NO: 7473 - RNA, 22 nt, Homo sapiens
ccagcaucuuucuuguuuacau

SEQ ID NO: 7474 - RNA, 22 nt, Homo sapiens
cagcaucuuucuuguuuacauc

SEQ ID NO: 7475 - RNA, 22 nt, Homo sapiens
agcaucuuucuuguuuacaucu

SEQ ID NO: 7476 - RNA, 22 nt, Homo sapiens
gcaucuuucuuguuuacaucuu

SEQ ID NO: 7477 - RNA, 22 nt, Homo sapiens
caucuuucuuguuuacaucuuu

SEQ ID NO: 7478 - RNA, 22 nt, Homo sapiens
aucuuucuuguuuacaucuuuu

SEQ ID NO: 7479 - RNA, 22 nt, Homo sapiens
ucuuucuuguuuacaucuuuua

SEQ ID NO: 7480 - RNA, 22 nt, Homo sapiens
cuuucuuguuuacaucuuuuau

SEQ ID NO: 7481 - RNA, 22 nt, Homo sapiens
uuucuuguuuacaucuuuuauc

SEQ ID NO: 7482 - RNA, 22 nt, Homo sapiens
uucuuguuuacaucuuuuauca

SEQ ID NO: 7483 - RNA, 22 nt, Homo sapiens
ucuuguuuacaucuuuuaucag

SEQ ID NO: 7484 - RNA, 22 nt, Homo sapiens
cuuguuuacaucuuuuaucagu

SEQ ID NO: 7485 - RNA, 22 nt, Homo sapiens
uuguuuacaucuuuuaucagua

SEQ ID NO: 7486 - RNA, 22 nt, Homo sapiens
uguuuacaucuuuuaucaguaa

SEQ ID NO: 7487 - RNA, 22 nt, Homo sapiens
guuuacaucuuuuaucaguaaa

SEQ ID NO: 7488 - RNA, 22 nt, Homo sapiens
uuuacaucuuuuaucaguaaag

SEQ ID NO: 7489 - RNA, 22 nt, Homo sapiens
uuacaucuuuuaucaguaaagu

SEQ ID NO: 7490 - RNA, 22 nt, Homo sapiens
uacaucuuuuaucaguaaagua

SEQ ID NO: 7491 - RNA, 22 nt, Homo sapiens
acaucuuuuaucaguaaaguaa

SEQ ID NO: 7492 - RNA, 22 nt, Homo sapiens
caucuuuuaucaguaaaguaac

SEQ ID NO: 7493 - RNA, 22 nt, Homo sapiens
aucuuuuaucaguaaaguaacu

SEQ ID NO: 7494 - RNA, 22 nt, Homo sapiens
ucuuuuaucaguaaaguaacuc

SEQ ID NO: 7495 - RNA, 22 nt, Homo sapiens
cuuuuaucaguaaaguaacucu

SEQ ID NO: 7496 - RNA, 22 nt, Homo sapiens
uuuuaucaguaaaguaacucuu

SEQ ID NO: 7497 - RNA, 22 nt, Homo sapiens
uuuaucaguaaaguaacucuuc

SEQ ID NO: 7498 - RNA, 22 nt, Homo sapiens
uuaucaguaaaguaacucuucc

SEQ ID NO: 7499 - RNA, 22 nt, Homo sapiens
uaucaguaaaguaacucuucca

SEQ ID NO: 7500 - RNA, 22 nt, Homo sapiens
aucaguaaaguaacucuuccag

SEQ ID NO: 7501 - RNA, 22 nt, Homo sapiens
ucaguaaaguaacucuuccagu

SEQ ID NO: 7502 - RNA, 22 nt, Homo sapiens
caguaaaguaacucuuccagug

SEQ ID NO: 7503 - RNA, 22 nt, Homo sapiens
aguaaaguaacucuuccagugu

SEQ ID NO: 7504 - RNA, 22 nt, Homo sapiens
guaaaguaacucuuccaguguu

SEQ ID NO: 7505 - RNA, 22 nt, Homo sapiens
uaaaguaacucuuccaguguua

SEQ ID NO: 7506 - RNA, 22 nt, Homo sapiens
aaaguaacucuuccaguguuau

SEQ ID NO: 7507 - RNA, 22 nt, Homo sapiens
aaguaacucuuccaguguuauc

SEQ ID NO: 7508 - RNA, 22 nt, Homo sapiens
aguaacucuuccaguguuaucu

SEQ ID NO: 7509 - RNA, 22 nt, Homo sapiens
guaacucuuccaguguuaucuu

SEQ ID NO: 7510 - RNA, 22 nt, Homo sapiens
uaacucuuccaguguuaucuug

SEQ ID NO: 7511 - RNA, 22 nt, Homo sapiens
aacucuuccaguguuaucuuga

SEQ ID NO: 7512 - RNA, 22 nt, Homo sapiens
acucuuccaguguuaucuugau

SEQ ID NO: 7513 - RNA, 22 nt, Homo sapiens
cucuuccaguguuaucuugaua

SEQ ID NO: 7514 - RNA, 22 nt, Homo sapiens
ucuuccaguguuaucuugauau

SEQ ID NO: 7515 - RNA, 22 nt, Homo sapiens
cuuccaguguuaucuugauaua

SEQ ID NO: 7516 - RNA, 22 nt, Homo sapiens
uuccaguguuaucuugauauaa

SEQ ID NO: 7517 - RNA, 22 nt, Homo sapiens
uccaguguuaucuugauauaag

SEQ ID NO: 7518 - RNA, 22 nt, Homo sapiens
ccaguguuaucuugauauaagc

SEQ ID NO: 7519 - RNA, 22 nt, Homo sapiens
caguguuaucuugauauaagcu

SEQ ID NO: 7520 - RNA, 22 nt, Homo sapiens
aguguuaucuugauauaagcuu

SEQ ID NO: 7521 - RNA, 22 nt, Homo sapiens
guguuaucuugauauaagcuua

SEQ ID NO: 7522 - RNA, 22 nt, Homo sapiens
uguuaucuugauauaagcuuau

SEQ ID NO: 7523 - RNA, 22 nt, Homo sapiens
guuaucuugauauaagcuuauu

SEQ ID NO: 7524 - RNA, 22 nt, Homo sapiens
uuaucuugauauaagcuuauuc

SEQ ID NO: 7525 - RNA, 22 nt, Homo sapiens
uaucuugauauaagcuuauucg

SEQ ID NO: 7526 - RNA, 22 nt, Homo sapiens
aucuugauauaagcuuauucgg

SEQ ID NO: 7527 - RNA, 22 nt, Homo sapiens
ucuugauauaagcuuauucggu

SEQ ID NO: 7528 - RNA, 22 nt, Homo sapiens
cuugauauaagcuuauucgguc

SEQ ID NO: 7529 - RNA, 22 nt, Homo sapiens
uugauauaagcuuauucgguca

SEQ ID NO: 7530 - RNA, 22 nt, Homo sapiens
ugauauaagcuuauucggucag

SEQ ID NO: 7531 - RNA, 22 nt, Homo sapiens
gauauaagcuuauucggucagu

SEQ ID NO: 7532 - RNA, 22 nt, Homo sapiens
auauaagcuuauucggucagug

SEQ ID NO: 7533 - RNA, 22 nt, Homo sapiens
uauaagcuuauucggucagugu

SEQ ID NO: 7534 - RNA, 22 nt, Homo sapiens
auaagcuuauucggucaguguu

SEQ ID NO: 7535 - RNA, 22 nt, Homo sapiens
uaagcuuauucggucaguguug

SEQ ID NO: 7536 - RNA, 22 nt, Homo sapiens
aagcuuauucggucaguguuga

SEQ ID NO: 7537 - RNA, 22 nt, Homo sapiens
agcuuauucggucaguguugaa

SEQ ID NO: 7538 - RNA, 22 nt, Homo sapiens
gcuuauucggucaguguugaau

SEQ ID NO: 7539 - RNA, 22 nt, Homo sapiens
cuuauucggucaguguugaauu

SEQ ID NO: 7540 - RNA, 22 nt, Homo sapiens
uuauucggucaguguugaauug

SEQ ID NO: 7541 - RNA, 22 nt, Homo sapiens
uauucggucaguguugaauugu

SEQ ID NO: 7542 - RNA, 22 nt, Homo sapiens
auucggucaguguugaauugua

SEQ ID NO: 7543 - RNA, 22 nt, Homo sapiens
uucggucaguguugaauuguac

SEQ ID NO: 7544 - RNA, 22 nt, Homo sapiens
ucggucaguguugaauuguacc

SEQ ID NO: 7545 - RNA, 22 nt, Homo sapiens
cggucaguguugaauuguacca

SEQ ID NO: 7546 - RNA, 22 nt, Homo sapiens
ggucaguguugaauuguaccau

SEQ ID NO: 7547 - RNA, 22 nt, Homo sapiens
gucaguguugaauuguaccauu

SEQ ID NO: 7548 - RNA, 22 nt, Homo sapiens
ucaguguugaauuguaccauuu

SEQ ID NO: 7549 - RNA, 22 nt, Homo sapiens
caguguugaauuguaccauuuc

SEQ ID NO: 7550 - RNA, 22 nt, Homo sapiens
aguguugaauuguaccauuuca

SEQ ID NO: 7551 - RNA, 22 nt, Homo sapiens
guguugaauuguaccauuucau

SEQ ID NO: 7552 - RNA, 22 nt, Homo sapiens
uguugaauuguaccauuucauu

SEQ ID NO: 7553 - RNA, 22 nt, Homo sapiens
guugaauuguaccauuucauua

SEQ ID NO: 7554 - RNA, 22 nt, Homo sapiens
uugaauuguaccauuucauuau

SEQ ID NO: 7555 - RNA, 22 nt, Homo sapiens
ugaauuguaccauuucauuauu

SEQ ID NO: 7556 - RNA, 22 nt, Homo sapiens
gaauuguaccauuucauuauuu

SEQ ID NO: 7557 - RNA, 22 nt, Homo sapiens
aauuguaccauuucauuauuuc

SEQ ID NO: 7558 - RNA, 22 nt, Homo sapiens
auuguaccauuucauuauuucu

SEQ ID NO: 7559 - RNA, 22 nt, Homo sapiens
uuguaccauuucauuauuucuu

SEQ ID NO: 7560 - RNA, 22 nt, Homo sapiens
uguaccauuucauuauuucuuu

SEQ ID NO: 7561 - RNA, 22 nt, Homo sapiens
guaccauuucauuauuucuuuu

SEQ ID NO: 7562 - RNA, 22 nt, Homo sapiens
uaccauuucauuauuucuuuuc

SEQ ID NO: 7563 - RNA, 22 nt, Homo sapiens
accauuucauuauuucuuuucc

SEQ ID NO: 7564 - RNA, 22 nt, Homo sapiens
ccauuucauuauuucuuuucca

SEQ ID NO: 7565 - RNA, 22 nt, Homo sapiens
cauuucauuauuucuuuuccag

SEQ ID NO: 7566 - RNA, 22 nt, Homo sapiens
auuucauuauuucuuuuccaga

SEQ ID NO: 7567 - RNA, 22 nt, Homo sapiens
uuucauuauuucuuuuccagaa

SEQ ID NO: 7568 - RNA, 22 nt, Homo sapiens
uucauuauuucuuuuccagaaa

SEQ ID NO: 7569 - RNA, 22 nt, Homo sapiens
ucauuauuucuuuuccagaaaa

SEQ ID NO: 7570 - RNA, 22 nt, Homo sapiens
cauuauuucuuuuccagaaaag

SEQ ID NO: 7571 - RNA, 22 nt, Homo sapiens
auuauuucuuuuccagaaaagc

SEQ ID NO: 7572 - RNA, 22 nt, Homo sapiens
uuauuucuuuuccagaaaagcu

SEQ ID NO: 7573 - RNA, 22 nt, Homo sapiens
uauuucuuuuccagaaaagcuu

SEQ ID NO: 7574 - RNA, 22 nt, Homo sapiens
auuucuuuuccagaaaagcuuu

SEQ ID NO: 7575 - RNA, 22 nt, Homo sapiens
uuucuuuuccagaaaagcuuug

SEQ ID NO: 7576 - RNA, 22 nt, Homo sapiens
uucuuuuccagaaaagcuuugg

SEQ ID NO: 7577 - RNA, 22 nt, Homo sapiens
ucuuuuccagaaaagcuuuggu

SEQ ID NO: 7578 - RNA, 22 nt, Homo sapiens
cuuuuccagaaaagcuuuggug

SEQ ID NO: 7579 - RNA, 22 nt, Homo sapiens
uuuuccagaaaagcuuuggugg

SEQ ID NO: 7580 - RNA, 22 nt, Homo sapiens
uuuccagaaaagcuuuggugga

SEQ ID NO: 7581 - RNA, 22 nt, Homo sapiens
uuccagaaaagcuuugguggag

SEQ ID NO: 7582 - RNA, 22 nt, Homo sapiens
uccagaaaagcuuugguggagg

SEQ ID NO: 7583 - RNA, 22 nt, Homo sapiens
ccagaaaagcuuugguggaggu

SEQ ID NO: 7584 - RNA, 22 nt, Homo sapiens
cagaaaagcuuugguggaggua

SEQ ID NO: 7585 - RNA, 22 nt, Homo sapiens
agaaaagcuuugguggagguau

SEQ ID NO: 7586 - RNA, 22 nt, Homo sapiens
gaaaagcuuugguggagguaua

SEQ ID NO: 7587 - RNA, 22 nt, Homo sapiens
aaaagcuuugguggagguauag

SEQ ID NO: 7588 - RNA, 22 nt, Homo sapiens
aaagcuuugguggagguauagc

SEQ ID NO: 7589 - RNA, 22 nt, Homo sapiens
aagcuuugguggagguauagcc

SEQ ID NO: 7590 - RNA, 22 nt, Homo sapiens
agcuuugguggagguauagccg

SEQ ID NO: 7591 - RNA, 22 nt, Homo sapiens
gcuuugguggagguauagccga

SEQ ID NO: 7592 - RNA, 22 nt, Homo sapiens
cuuugguggagguauagccgag

SEQ ID NO: 7593 - RNA, 22 nt, Homo sapiens
uuugguggagguauagccgaga

SEQ ID NO: 7594 - RNA, 22 nt, Homo sapiens
uugguggagguauagccgagau

SEQ ID NO: 7595 - RNA, 22 nt, Homo sapiens
ugguggagguauagccgagauc

SEQ ID NO: 7596 - RNA, 22 nt, Homo sapiens
gguggagguauagccgagaucu

SEQ ID NO: 7597 - RNA, 22 nt, Homo sapiens
guggagguauagccgagaucug

SEQ ID NO: 7598 - RNA, 22 nt, Homo sapiens
uggagguauagccgagaucugg

SEQ ID NO: 7599 - RNA, 22 nt, Homo sapiens
ggagguauagccgagaucuggc

SEQ ID NO: 7600 - RNA, 22 nt, Homo sapiens
gagguauagccgagaucuggca

SEQ ID NO: 7601 - RNA, 22 nt, Homo sapiens
agguauagccgagaucuggcau

SEQ ID NO: 7602 - RNA, 22 nt, Homo sapiens
gguauagccgagaucuggcauu

SEQ ID NO: 7603 - RNA, 22 nt, Homo sapiens
guauagccgagaucuggcauuc

SEQ ID NO: 7604 - RNA, 22 nt, Homo sapiens
uauagccgagaucuggcauucu

SEQ ID NO: 7605 - RNA, 22 nt, Homo sapiens
auagccgagaucuggcauucua

SEQ ID NO: 7606 - RNA, 22 nt, Homo sapiens
uagccgagaucuggcauucuag

SEQ ID NO: 7607 - RNA, 22 nt, Homo sapiens
agccgagaucuggcauucuagu

SEQ ID NO: 7608 - RNA, 22 nt, Homo sapiens
gccgagaucuggcauucuaguu

SEQ ID NO: 7609 - RNA, 22 nt, Homo sapiens
ccgagaucuggcauucuaguuu

SEQ ID NO: 7610 - RNA, 22 nt, Homo sapiens
cgagaucuggcauucuaguuuc

SEQ ID NO: 7611 - RNA, 22 nt, Homo sapiens
gagaucuggcauucuaguuuca

SEQ ID NO: 7612 - RNA, 22 nt, Homo sapiens
agaucuggcauucuaguuucac

SEQ ID NO: 7613 - RNA, 22 nt, Homo sapiens
gaucuggcauucuaguuucacu

SEQ ID NO: 7614 - RNA, 22 nt, Homo sapiens
aucuggcauucuaguuucacug

SEQ ID NO: 7615 - RNA, 22 nt, Homo sapiens
ucuggcauucuaguuucacuga

SEQ ID NO: 7616 - RNA, 22 nt, Homo sapiens
cuggcauucuaguuucacugaa

SEQ ID NO: 7617 - RNA, 22 nt, Homo sapiens
uggcauucuaguuucacugaau

SEQ ID NO: 7618 - RNA, 22 nt, Homo sapiens
ggcauucuaguuucacugaauc

SEQ ID NO: 7619 - RNA, 22 nt, Homo sapiens
gcauucuaguuucacugaaucu

SEQ ID NO: 7620 - RNA, 22 nt, Homo sapiens
cauucuaguuucacugaaucuc

SEQ ID NO: 7621 - RNA, 22 nt, Homo sapiens
auucuaguuucacugaaucucc

SEQ ID NO: 7622 - RNA, 22 nt, Homo sapiens
uucuaguuucacugaaucuccc

SEQ ID NO: 7623 - RNA, 22 nt, Homo sapiens
ucuaguuucacugaaucucccu

SEQ ID NO: 7624 - RNA, 22 nt, Homo sapiens
cuaguuucacugaaucucccuc

SEQ ID NO: 7625 - RNA, 22 nt, Homo sapiens
uaguuucacugaaucucccucu

SEQ ID NO: 7626 - RNA, 22 nt, Homo sapiens
aguuucacugaaucucccucua

SEQ ID NO: 7627 - RNA, 22 nt, Homo sapiens
guuucacugaaucucccucuaa

SEQ ID NO: 7628 - RNA, 22 nt, Homo sapiens
uuucacugaaucucccucuaaa

SEQ ID NO: 7629 - RNA, 22 nt, Homo sapiens
uucacugaaucucccucuaaaa

SEQ ID NO: 7630 - RNA, 22 nt, Homo sapiens
ucacugaaucucccucuaaaac

SEQ ID NO: 7631 - RNA, 22 nt, Homo sapiens
cacugaaucucccucuaaaacu

SEQ ID NO: 7632 - RNA, 22 nt, Homo sapiens
acugaaucucccucuaaaacuu

SEQ ID NO: 7633 - RNA, 22 nt, Homo sapiens
cugaaucucccucuaaaacuuu

SEQ ID NO: 7634 - RNA, 22 nt, Homo sapiens
ugaaucucccucuaaaacuuuu

SEQ ID NO: 7635 - RNA, 22 nt, Homo sapiens
gaaucucccucuaaaacuuuuu

SEQ ID NO: 7636 - RNA, 22 nt, Homo sapiens
aaucucccucuaaaacuuuuuu

SEQ ID NO: 7637 - RNA, 22 nt, Homo sapiens
aucucccucuaaaacuuuuuug

SEQ ID NO: 7638 - RNA, 22 nt, Homo sapiens
ucucccucuaaaacuuuuuugc

SEQ ID NO: 7639 - RNA, 22 nt, Homo sapiens
cucccucuaaaacuuuuuugcu

SEQ ID NO: 7640 - RNA, 22 nt, Homo sapiens
ucccucuaaaacuuuuuugcuc

SEQ ID NO: 7641 - RNA, 22 nt, Homo sapiens
cccucuaaaacuuuuuugcucu

SEQ ID NO: 7642 - RNA, 22 nt, Homo sapiens
ccucuaaaacuuuuuugcucug

SEQ ID NO: 7643 - RNA, 22 nt, Homo sapiens
cucuaaaacuuuuuugcucugu

SEQ ID NO: 7644 - RNA, 22 nt, Homo sapiens
ucuaaaacuuuuuugcucugug

SEQ ID NO: 7645 - RNA, 22 nt, Homo sapiens
cuaaaacuuuuuugcucugugg

SEQ ID NO: 7646 - RNA, 22 nt, Homo sapiens
uaaaacuuuuuugcucuguggu

SEQ ID NO: 7647 - RNA, 22 nt, Homo sapiens
aaaacuuuuuugcucugugguu

SEQ ID NO: 7648 - RNA, 22 nt, Homo sapiens
aaacuuuuuugcucugugguuu

SEQ ID NO: 7649 - RNA, 22 nt, Homo sapiens
aacuuuuuugcucugugguuug

SEQ ID NO: 7650 - RNA, 22 nt, Homo sapiens
acuuuuuugcucugugguuugu

SEQ ID NO: 7651 - RNA, 22 nt, Homo sapiens
cuuuuuugcucugugguuugua

SEQ ID NO: 7652 - RNA, 22 nt, Homo sapiens
uuuuuugcucugugguuuguag

SEQ ID NO: 7653 - RNA, 22 nt, Homo sapiens
uuuuugcucugugguuuguaga

SEQ ID NO: 7654 - RNA, 22 nt, Homo sapiens
uuuugcucugugguuuguagau

SEQ ID NO: 7655 - RNA, 22 nt, Homo sapiens
uuugcucugugguuuguagaua

SEQ ID NO: 7656 - RNA, 22 nt, Homo sapiens
uugcucugugguuuguagauaa

SEQ ID NO: 7657 - RNA, 22 nt, Homo sapiens
ugcucugugguuuguagauaaa

SEQ ID NO: 7658 - RNA, 22 nt, Homo sapiens
gcucugugguuuguagauaaac

SEQ ID NO: 7659 - RNA, 22 nt, Homo sapiens
cucugugguuuguagauaaaca

SEQ ID NO: 7660 - RNA, 22 nt, Homo sapiens
ucugugguuuguagauaaacau

SEQ ID NO: 7661 - RNA, 22 nt, Homo sapiens
cugugguuuguagauaaacauu

SEQ ID NO: 7662 - RNA, 22 nt, Homo sapiens
ugugguuuguagauaaacauug

SEQ ID NO: 7663 - RNA, 22 nt, Homo sapiens
gugguuuguagauaaacauugg

SEQ ID NO: 7664 - RNA, 22 nt, Homo sapiens
ugguuuguagauaaacauuggu

SEQ ID NO: 7665 - RNA, 22 nt, Homo sapiens
gguuuguagauaaacauuggug

SEQ ID NO: 7666 - RNA, 22 nt, Homo sapiens
guuuguagauaaacauuggugc

SEQ ID NO: 7667 - RNA, 22 nt, Homo sapiens
uuuguagauaaacauuggugcu

SEQ ID NO: 7668 - RNA, 22 nt, Homo sapiens
uuguagauaaacauuggugcuc

SEQ ID NO: 7669 - RNA, 22 nt, Homo sapiens
uguagauaaacauuggugcucu

SEQ ID NO: 7670 - RNA, 22 nt, Homo sapiens
guagauaaacauuggugcucuu

SEQ ID NO: 7671 - RNA, 22 nt, Homo sapiens
uagauaaacauuggugcucuuu

SEQ ID NO: 7672 - RNA, 22 nt, Homo sapiens
agauaaacauuggugcucuuuu

SEQ ID NO: 7673 - RNA, 22 nt, Homo sapiens
gauaaacauuggugcucuuuua

SEQ ID NO: 7674 - RNA, 22 nt, Homo sapiens
auaaacauuggugcucuuuuau

SEQ ID NO: 7675 - RNA, 22 nt, Homo sapiens
uaaacauuggugcucuuuuaug

SEQ ID NO: 7676 - RNA, 22 nt, Homo sapiens
aaacauuggugcucuuuuaugu

SEQ ID NO: 7677 - RNA, 22 nt, Homo sapiens
aacauuggugcucuuuuauguu

SEQ ID NO: 7678 - RNA, 22 nt, Homo sapiens
acauuggugcucuuuuauguuc

SEQ ID NO: 7679 - RNA, 22 nt, Homo sapiens
cauuggugcucuuuuauguucu

SEQ ID NO: 7680 - RNA, 22 nt, Homo sapiens
auuggugcucuuuuauguucuu

SEQ ID NO: 7681 - RNA, 22 nt, Homo sapiens
uuggugcucuuuuauguucuuu

SEQ ID NO: 7682 - RNA, 22 nt, Homo sapiens
uggugcucuuuuauguucuuuu

SEQ ID NO: 7683 - RNA, 22 nt, Homo sapiens
ggugcucuuuuauguucuuuug

SEQ ID NO: 7684 - RNA, 22 nt, Homo sapiens
gugcucuuuuauguucuuuugc

SEQ ID NO: 7685 - RNA, 22 nt, Homo sapiens
ugcucuuuuauguucuuuugca

SEQ ID NO: 7686 - RNA, 22 nt, Homo sapiens
gcucuuuuauguucuuuugcaa

SEQ ID NO: 7687 - RNA, 22 nt, Homo sapiens
cucuuuuauguucuuuugcaag

SEQ ID NO: 7688 - RNA, 22 nt, Homo sapiens
ucuuuuauguucuuuugcaagg

SEQ ID NO: 7689 - RNA, 22 nt, Homo sapiens
cuuuuauguucuuuugcaagga

SEQ ID NO: 7690 - RNA, 22 nt, Homo sapiens
uuuuauguucuuuugcaaggac

SEQ ID NO: 7691 - RNA, 22 nt, Homo sapiens
uuuauguucuuuugcaaggaca

SEQ ID NO: 7692 - RNA, 22 nt, Homo sapiens
uuauguucuuuugcaaggacau

SEQ ID NO: 7693 - RNA, 22 nt, Homo sapiens
uauguucuuuugcaaggacauc

SEQ ID NO: 7694 - RNA, 22 nt, Homo sapiens
auguucuuuugcaaggacaucc

SEQ ID NO: 7695 - RNA, 22 nt, Homo sapiens
uguucuuuugcaaggacaucca

SEQ ID NO: 7696 - RNA, 22 nt, Homo sapiens
guucuuuugcaaggacauccag

SEQ ID NO: 7697 - RNA, 22 nt, Homo sapiens
uucuuuugcaaggacauccagc

SEQ ID NO: 7698 - RNA, 22 nt, Homo sapiens
ucuuuugcaaggacauccagcu

SEQ ID NO: 7699 - RNA, 22 nt, Homo sapiens
cuuuugcaaggacauccagcug

SEQ ID NO: 7700 - RNA, 22 nt, Homo sapiens
uuuugcaaggacauccagcugc

SEQ ID NO: 7701 - RNA, 22 nt, Homo sapiens
uuugcaaggacauccagcugca

SEQ ID NO: 7702 - RNA, 22 nt, Homo sapiens
uugcaaggacauccagcugcac

SEQ ID NO: 7703 - RNA, 22 nt, Homo sapiens
ugcaaggacauccagcugcaca

SEQ ID NO: 7704 - RNA, 22 nt, Homo sapiens
gcaaggacauccagcugcacag

SEQ ID NO: 7705 - RNA, 22 nt, Homo sapiens
caaggacauccagcugcacagu

SEQ ID NO: 7706 - RNA, 22 nt, Homo sapiens
aaggacauccagcugcacagug

SEQ ID NO: 7707 - RNA, 22 nt, Homo sapiens
aggacauccagcugcacaguga

SEQ ID NO: 7708 - RNA, 22 nt, Homo sapiens
ggacauccagcugcacagugaa

SEQ ID NO: 7709 - RNA, 22 nt, Homo sapiens
gacauccagcugcacagugaag

SEQ ID NO: 7710 - RNA, 22 nt, Homo sapiens
acauccagcugcacagugaagg

SEQ ID NO: 7711 - RNA, 22 nt, Homo sapiens
cauccagcugcacagugaaggu

SEQ ID NO: 7712 - RNA, 22 nt, Homo sapiens
auccagcugcacagugaaggug

SEQ ID NO: 7713 - RNA, 22 nt, Homo sapiens
uccagcugcacagugaaggugg

SEQ ID NO: 7714 - RNA, 22 nt, Homo sapiens
ccagcugcacagugaagguggc

SEQ ID NO: 7715 - RNA, 22 nt, Homo sapiens
cagcugcacagugaagguggcu

SEQ ID NO: 7716 - RNA, 22 nt, Homo sapiens
agcugcacagugaagguggcuu

SEQ ID NO: 7717 - RNA, 22 nt, Homo sapiens
gcugcacagugaagguggcuuc

SEQ ID NO: 7718 - RNA, 22 nt, Homo sapiens
cugcacagugaagguggcuucu

SEQ ID NO: 7719 - RNA, 22 nt, Homo sapiens
ugcacagugaagguggcuucuc

SEQ ID NO: 7720 - RNA, 22 nt, Homo sapiens
gcacagugaagguggcuucucc

SEQ ID NO: 7721 - RNA, 22 nt, Homo sapiens
cacagugaagguggcuucuccu

SEQ ID NO: 7722 - RNA, 22 nt, Homo sapiens
acagugaagguggcuucuccug

SEQ ID NO: 7723 - RNA, 22 nt, Homo sapiens
cagugaagguggcuucuccugc

SEQ ID NO: 7724 - RNA, 22 nt, Homo sapiens
agugaagguggcuucuccugcu

SEQ ID NO: 7725 - RNA, 22 nt, Homo sapiens
gugaagguggcuucuccugcuc

SEQ ID NO: 7726 - RNA, 22 nt, Homo sapiens
ugaagguggcuucuccugcucu

SEQ ID NO: 7727 - RNA, 22 nt, Homo sapiens
gaagguggcuucuccugcucua

SEQ ID NO: 7728 - RNA, 22 nt, Homo sapiens
aagguggcuucuccugcucuau

SEQ ID NO: 7729 - RNA, 22 nt, Homo sapiens
agguggcuucuccugcucuauu

SEQ ID NO: 7730 - RNA, 22 nt, Homo sapiens
gguggcuucuccugcucuauuc

SEQ ID NO: 7731 - RNA, 22 nt, Homo sapiens
guggcuucuccugcucuauucu

SEQ ID NO: 7732 - RNA, 22 nt, Homo sapiens
uggcuucuccugcucuauucuu

SEQ ID NO: 7733 - RNA, 22 nt, Homo sapiens
ggcuucuccugcucuauucuug

SEQ ID NO: 7734 - RNA, 22 nt, Homo sapiens
gcuucuccugcucuauucuugg

SEQ ID NO: 7735 - RNA, 22 nt, Homo sapiens
cuucuccugcucuauucuuggc

SEQ ID NO: 7736 - RNA, 22 nt, Homo sapiens
uucuccugcucuauucuuggca

SEQ ID NO: 7737 - RNA, 22 nt, Homo sapiens
ucuccugcucuauucuuggcaa

SEQ ID NO: 7738 - RNA, 22 nt, Homo sapiens
cuccugcucuauucuuggcaac

SEQ ID NO: 7739 - RNA, 22 nt, Homo sapiens
uccugcucuauucuuggcaaca

SEQ ID NO: 7740 - RNA, 22 nt, Homo sapiens
ccugcucuauucuuggcaacac

SEQ ID NO: 7741 - RNA, 22 nt, Homo sapiens
cugcucuauucuuggcaacaca

SEQ ID NO: 7742 - RNA, 22 nt, Homo sapiens
ugcucuauucuuggcaacacau

SEQ ID NO: 7743 - RNA, 22 nt, Homo sapiens
gcucuauucuuggcaacacaug

SEQ ID NO: 7744 - RNA, 22 nt, Homo sapiens
cucuauucuuggcaacacaugc

SEQ ID NO: 7745 - RNA, 22 nt, Homo sapiens
ucuauucuuggcaacacaugca

SEQ ID NO: 7746 - RNA, 22 nt, Homo sapiens
cuauucuuggcaacacaugcau

SEQ ID NO: 7747 - RNA, 22 nt, Homo sapiens
uauucuuggcaacacaugcaua

SEQ ID NO: 7748 - RNA, 22 nt, Homo sapiens
auucuuggcaacacaugcauaa

SEQ ID NO: 7749 - RNA, 22 nt, Homo sapiens
uucuuggcaacacaugcauaag

SEQ ID NO: 7750 - RNA, 22 nt, Homo sapiens
ucuuggcaacacaugcauaagc

SEQ ID NO: 7751 - RNA, 22 nt, Homo sapiens
cuuggcaacacaugcauaagcc

SEQ ID NO: 7752 - RNA, 22 nt, Homo sapiens
uuggcaacacaugcauaagccc

SEQ ID NO: 7753 - RNA, 22 nt, Homo sapiens
uggcaacacaugcauaagcccc

SEQ ID NO: 7754 - RNA, 22 nt, Homo sapiens
ggcaacacaugcauaagccccu

SEQ ID NO: 7755 - RNA, 22 nt, Homo sapiens
gcaacacaugcauaagccccug

SEQ ID NO: 7756 - RNA, 22 nt, Homo sapiens
caacacaugcauaagccccugc

SEQ ID NO: 7757 - RNA, 22 nt, Homo sapiens
aacacaugcauaagccccugca

SEQ ID NO: 7758 - RNA, 22 nt, Homo sapiens
acacaugcauaagccccugcau

SEQ ID NO: 7759 - RNA, 22 nt, Homo sapiens
cacaugcauaagccccugcauc

SEQ ID NO: 7760 - RNA, 22 nt, Homo sapiens
acaugcauaagccccugcaucu

SEQ ID NO: 7761 - RNA, 22 nt, Homo sapiens
caugcauaagccccugcaucug

SEQ ID NO: 7762 - RNA, 22 nt, Homo sapiens
augcauaagccccugcaucuga

SEQ ID NO: 7763 - RNA, 22 nt, Homo sapiens
ugcauaagccccugcaucugaa

SEQ ID NO: 7764 - RNA, 22 nt, Homo sapiens
gcauaagccccugcaucugaag

SEQ ID NO: 7765 - RNA, 22 nt, Homo sapiens
cauaagccccugcaucugaagc

SEQ ID NO: 7766 - RNA, 22 nt, Homo sapiens
auaagccccugcaucugaagcu

SEQ ID NO: 7767 - RNA, 22 nt, Homo sapiens
uaagccccugcaucugaagcuc

SEQ ID NO: 7768 - RNA, 22 nt, Homo sapiens
aagccccugcaucugaagcucu

SEQ ID NO: 7769 - RNA, 22 nt, Homo sapiens
agccccugcaucugaagcucug

SEQ ID NO: 7770 - RNA, 22 nt, Homo sapiens
gccccugcaucugaagcucuga

SEQ ID NO: 7771 - RNA, 22 nt, Homo sapiens
ccccugcaucugaagcucugac

SEQ ID NO: 7772 - RNA, 22 nt, Homo sapiens
cccugcaucugaagcucugacu

SEQ ID NO: 7773 - RNA, 22 nt, Homo sapiens
ccugcaucugaagcucugacua

SEQ ID NO: 7774 - RNA, 22 nt, Homo sapiens
cugcaucugaagcucugacuac

SEQ ID NO: 7775 - RNA, 22 nt, Homo sapiens
ugcaucugaagcucugacuacu

SEQ ID NO: 7776 - RNA, 22 nt, Homo sapiens
gcaucugaagcucugacuacuu

SEQ ID NO: 7777 - RNA, 22 nt, Homo sapiens
caucugaagcucugacuacuuc

SEQ ID NO: 7778 - RNA, 22 nt, Homo sapiens
aucugaagcucugacuacuuca

SEQ ID NO: 7779 - RNA, 22 nt, Homo sapiens
ucugaagcucugacuacuucaa

SEQ ID NO: 7780 - RNA, 22 nt, Homo sapiens
cugaagcucugacuacuucaaa

SEQ ID NO: 7781 - RNA, 22 nt, Homo sapiens
ugaagcucugacuacuucaaag

SEQ ID NO: 7782 - RNA, 22 nt, Homo sapiens
gaagcucugacuacuucaaaga

SEQ ID NO: 7783 - RNA, 22 nt, Homo sapiens
aagcucugacuacuucaaagau

SEQ ID NO: 7784 - RNA, 22 nt, Homo sapiens
agcucugacuacuucaaagaug

SEQ ID NO: 7785 - RNA, 22 nt, Homo sapiens
gcucugacuacuucaaagauga

SEQ ID NO: 7786 - RNA, 22 nt, Homo sapiens
cucugacuacuucaaagaugag

SEQ ID NO: 7787 - RNA, 22 nt, Homo sapiens
ucugacuacuucaaagaugagu

SEQ ID NO: 7788 - RNA, 22 nt, Homo sapiens
cugacuacuucaaagaugagug

SEQ ID NO: 7789 - RNA, 22 nt, Homo sapiens
ugacuacuucaaagaugaguga

SEQ ID NO: 7790 - RNA, 22 nt, Homo sapiens
gacuacuucaaagaugagugaa

SEQ ID NO: 7791 - RNA, 22 nt, Homo sapiens
acuacuucaaagaugagugaau

SEQ ID NO: 7792 - RNA, 22 nt, Homo sapiens
cuacuucaaagaugagugaaug

SEQ ID NO: 7793 - RNA, 22 nt, Homo sapiens
uacuucaaagaugagugaauga

SEQ ID NO: 7794 - RNA, 22 nt, Homo sapiens
acuucaaagaugagugaaugaa

SEQ ID NO: 7795 - RNA, 22 nt, Homo sapiens
cuucaaagaugagugaaugaag

SEQ ID NO: 7796 - RNA, 22 nt, Homo sapiens
uucaaagaugagugaaugaaga

SEQ ID NO: 7797 - RNA, 22 nt, Homo sapiens
ucaaagaugagugaaugaagac

SEQ ID NO: 7798 - RNA, 22 nt, Homo sapiens
caaagaugagugaaugaagacc

SEQ ID NO: 7799 - RNA, 22 nt, Homo sapiens
aaagaugagugaaugaagaccc

SEQ ID NO: 7800 - RNA, 22 nt, Homo sapiens
aagaugagugaaugaagacccu

SEQ ID NO: 7801 - RNA, 22 nt, Homo sapiens
agaugagugaaugaagacccuu

SEQ ID NO: 7802 - RNA, 22 nt, Homo sapiens
gaugagugaaugaagacccuuc

SEQ ID NO: 7803 - RNA, 22 nt, Homo sapiens
augagugaaugaagacccuucu

SEQ ID NO: 7804 - RNA, 22 nt, Homo sapiens
ugagugaaugaagacccuucuc

SEQ ID NO: 7805 - RNA, 22 nt, Homo sapiens
gagugaaugaagacccuucuca

SEQ ID NO: 7806 - RNA, 22 nt, Homo sapiens
agugaaugaagacccuucucag

SEQ ID NO: 7807 - RNA, 22 nt, Homo sapiens
gugaaugaagacccuucucaga

SEQ ID NO: 7808 - RNA, 22 nt, Homo sapiens
ugaaugaagacccuucucagac

SEQ ID NO: 7809 - RNA, 22 nt, Homo sapiens
gaaugaagacccuucucagaca

SEQ ID NO: 7810 - RNA, 22 nt, Homo sapiens
aaugaagacccuucucagacac

SEQ ID NO: 7811 - RNA, 22 nt, Homo sapiens
augaagacccuucucagacacu

SEQ ID NO: 7812 - RNA, 22 nt, Homo sapiens
ugaagacccuucucagacacua

SEQ ID NO: 7813 - RNA, 22 nt, Homo sapiens
gaagacccuucucagacacuau

SEQ ID NO: 7814 - RNA, 22 nt, Homo sapiens
aagacccuucucagacacuauc

SEQ ID NO: 7815 - RNA, 22 nt, Homo sapiens
agacccuucucagacacuauca

SEQ ID NO: 7816 - RNA, 22 nt, Homo sapiens
gacccuucucagacacuaucau

SEQ ID NO: 7817 - RNA, 22 nt, Homo sapiens
acccuucucagacacuaucauu

SEQ ID NO: 7818 - RNA, 22 nt, Homo sapiens
cccuucucagacacuaucauuu

SEQ ID NO: 7819 - RNA, 22 nt, Homo sapiens
ccuucucagacacuaucauuuu

SEQ ID NO: 7820 - RNA, 22 nt, Homo sapiens
cuucucagacacuaucauuuug

SEQ ID NO: 7821 - RNA, 22 nt, Homo sapiens
uucucagacacuaucauuuugu

SEQ ID NO: 7822 - RNA, 22 nt, Homo sapiens
ucucagacacuaucauuuugug

SEQ ID NO: 7823 - RNA, 22 nt, Homo sapiens
cucagacacuaucauuuugugc

SEQ ID NO: 7824 - RNA, 22 nt, Homo sapiens
ucagacacuaucauuuugugca

SEQ ID NO: 7825 - RNA, 22 nt, Homo sapiens
cagacacuaucauuuugugcaa

SEQ ID NO: 7826 - RNA, 22 nt, Homo sapiens
agacacuaucauuuugugcaaa

SEQ ID NO: 7827 - RNA, 22 nt, Homo sapiens
gacacuaucauuuugugcaaau

SEQ ID NO: 7828 - RNA, 22 nt, Homo sapiens
acacuaucauuuugugcaaauc

SEQ ID NO: 7829 - RNA, 22 nt, Homo sapiens
cacuaucauuuugugcaaauca

SEQ ID NO: 7830 - RNA, 22 nt, Homo sapiens
acuaucauuuugugcaaaucau

SEQ ID NO: 7831 - RNA, 22 nt, Homo sapiens
cuaucauuuugugcaaaucauc

SEQ ID NO: 7832 - RNA, 22 nt, Homo sapiens
uaucauuuugugcaaaucaucu

SEQ ID NO: 7833 - RNA, 22 nt, Homo sapiens
aucauuuugugcaaaucaucug

SEQ ID NO: 7834 - RNA, 22 nt, Homo sapiens
ucauuuugugcaaaucaucuga

SEQ ID NO: 7835 - RNA, 22 nt, Homo sapiens
cauuuugugcaaaucaucugau

SEQ ID NO: 7836 - RNA, 22 nt, Homo sapiens
auuuugugcaaaucaucugauu

SEQ ID NO: 7837 - RNA, 22 nt, Homo sapiens
uuuugugcaaaucaucugauug

SEQ ID NO: 7838 - RNA, 22 nt, Homo sapiens
uuugugcaaaucaucugauuga

SEQ ID NO: 7839 - RNA, 22 nt, Homo sapiens
uugugcaaaucaucugauugaa

SEQ ID NO: 7840 - RNA, 22 nt, Homo sapiens
ugugcaaaucaucugauugaac

SEQ ID NO: 7841 - RNA, 22 nt, Homo sapiens
gugcaaaucaucugauugaacu

SEQ ID NO: 7842 - RNA, 22 nt, Homo sapiens
ugcaaaucaucugauugaacug

SEQ ID NO: 7843 - RNA, 22 nt, Homo sapiens
gcaaaucaucugauugaacugu

SEQ ID NO: 7844 - RNA, 22 nt, Homo sapiens
caaaucaucugauugaacuguu

SEQ ID NO: 7845 - RNA, 22 nt, Homo sapiens
aaaucaucugauugaacuguuc

SEQ ID NO: 7846 - RNA, 22 nt, Homo sapiens
aaucaucugauugaacuguucu

SEQ ID NO: 7847 - RNA, 22 nt, Homo sapiens
aucaucugauugaacuguucuu

SEQ ID NO: 7848 - RNA, 22 nt, Homo sapiens
ucaucugauugaacuguucuuc

SEQ ID NO: 7849 - RNA, 22 nt, Homo sapiens
caucugauugaacuguucuucc

SEQ ID NO: 7850 - RNA, 22 nt, Homo sapiens
aucugauugaacuguucuucca

SEQ ID NO: 7851 - RNA, 22 nt, Homo sapiens
ucugauugaacuguucuuccau

SEQ ID NO: 7852 - RNA, 22 nt, Homo sapiens
cugauugaacuguucuuccauu

SEQ ID NO: 7853 - RNA, 22 nt, Homo sapiens
ugauugaacuguucuuccauuu

SEQ ID NO: 7854 - RNA, 22 nt, Homo sapiens
gauugaacuguucuuccauuua

SEQ ID NO: 7855 - RNA, 22 nt, Homo sapiens
auugaacuguucuuccauuuag

SEQ ID NO: 7856 - RNA, 22 nt, Homo sapiens
uugaacuguucuuccauuuaga

SEQ ID NO: 7857 - RNA, 22 nt, Homo sapiens
ugaacuguucuuccauuuagau

SEQ ID NO: 7858 - RNA, 22 nt, Homo sapiens
gaacuguucuuccauuuagaua

SEQ ID NO: 7859 - RNA, 22 nt, Homo sapiens
aacuguucuuccauuuagauac

SEQ ID NO: 7860 - RNA, 22 nt, Homo sapiens
acuguucuuccauuuagauacc

SEQ ID NO: 7861 - RNA, 22 nt, Homo sapiens
cuguucuuccauuuagauacca

SEQ ID NO: 7862 - RNA, 22 nt, Homo sapiens
uguucuuccauuuagauaccau

SEQ ID NO: 7863 - RNA, 22 nt, Homo sapiens
guucuuccauuuagauaccaug

SEQ ID NO: 7864 - RNA, 22 nt, Homo sapiens
uucuuccauuuagauaccauga

SEQ ID NO: 7865 - RNA, 22 nt, Homo sapiens
ucuuccauuuagauaccaugac

SEQ ID NO: 7866 - RNA, 22 nt, Homo sapiens
cuuccauuuagauaccaugaca

SEQ ID NO: 7867 - RNA, 22 nt, Homo sapiens
uuccauuuagauaccaugacac

SEQ ID NO: 7868 - RNA, 22 nt, Homo sapiens
uccauuuagauaccaugacaca

SEQ ID NO: 7869 - RNA, 22 nt, Homo sapiens
ccauuuagauaccaugacacau

SEQ ID NO: 7870 - RNA, 22 nt, Homo sapiens
cauuuagauaccaugacacauc

SEQ ID NO: 7871 - RNA, 22 nt, Homo sapiens
auuuagauaccaugacacauca

SEQ ID NO: 7872 - RNA, 22 nt, Homo sapiens
uuuagauaccaugacacaucag

SEQ ID NO: 7873 - RNA, 22 nt, Homo sapiens
uuagauaccaugacacaucagg

SEQ ID NO: 7874 - RNA, 22 nt, Homo sapiens
uagauaccaugacacaucagga

SEQ ID NO: 7875 - RNA, 22 nt, Homo sapiens
agauaccaugacacaucaggag

SEQ ID NO: 7876 - RNA, 22 nt, Homo sapiens
gauaccaugacacaucaggagc

SEQ ID NO: 7877 - RNA, 22 nt, Homo sapiens
auaccaugacacaucaggagcu

SEQ ID NO: 7878 - RNA, 22 nt, Homo sapiens
uaccaugacacaucaggagcug

SEQ ID NO: 7879 - RNA, 22 nt, Homo sapiens
accaugacacaucaggagcugg

SEQ ID NO: 7880 - RNA, 22 nt, Homo sapiens
ccaugacacaucaggagcuggc

SEQ ID NO: 7881 - RNA, 22 nt, Homo sapiens
caugacacaucaggagcuggca

SEQ ID NO: 7882 - RNA, 22 nt, Homo sapiens
augacacaucaggagcuggcag

SEQ ID NO: 7883 - RNA, 22 nt, Homo sapiens
ugacacaucaggagcuggcagu

SEQ ID NO: 7884 - RNA, 22 nt, Homo sapiens
gacacaucaggagcuggcaguc

SEQ ID NO: 7885 - RNA, 22 nt, Homo sapiens
acacaucaggagcuggcagucc

SEQ ID NO: 7886 - RNA, 22 nt, Homo sapiens
cacaucaggagcuggcagucca

SEQ ID NO: 7887 - RNA, 22 nt, Homo sapiens
acaucaggagcuggcaguccac

SEQ ID NO: 7888 - RNA, 22 nt, Homo sapiens
caucaggagcuggcaguccacu

SEQ ID NO: 7889 - RNA, 22 nt, Homo sapiens
aucaggagcuggcaguccacuc

SEQ ID NO: 7890 - RNA, 22 nt, Homo sapiens
ucaggagcuggcaguccacuca

SEQ ID NO: 7891 - RNA, 22 nt, Homo sapiens
caggagcuggcaguccacucac

SEQ ID NO: 7892 - RNA, 22 nt, Homo sapiens
aggagcuggcaguccacucacu

SEQ ID NO: 7893 - RNA, 22 nt, Homo sapiens
ggagcuggcaguccacucacuu

SEQ ID NO: 7894 - RNA, 22 nt, Homo sapiens
gagcuggcaguccacucacuuu

SEQ ID NO: 7895 - RNA, 22 nt, Homo sapiens
agcuggcaguccacucacuuug

SEQ ID NO: 7896 - RNA, 22 nt, Homo sapiens
gcuggcaguccacucacuuuga

SEQ ID NO: 7897 - RNA, 22 nt, Homo sapiens
cuggcaguccacucacuuugaa

SEQ ID NO: 7898 - RNA, 22 nt, Homo sapiens
uggcaguccacucacuuugaag

SEQ ID NO: 7899 - RNA, 22 nt, Homo sapiens
ggcaguccacucacuuugaagu

SEQ ID NO: 7900 - RNA, 22 nt, Homo sapiens
gcaguccacucacuuugaaguc

SEQ ID NO: 7901 - RNA, 22 nt, Homo sapiens
caguccacucacuuugaagucc

SEQ ID NO: 7902 - RNA, 22 nt, Homo sapiens
aguccacucacuuugaagucca

SEQ ID NO: 7903 - RNA, 22 nt, Homo sapiens
guccacucacuuugaaguccau

SEQ ID NO: 7904 - RNA, 22 nt, Homo sapiens
uccacucacuuugaaguccauu

SEQ ID NO: 7905 - RNA, 22 nt, Homo sapiens
ccacucacuuugaaguccauuc

SEQ ID NO: 7906 - RNA, 22 nt, Homo sapiens
cacucacuuugaaguccauucu

SEQ ID NO: 7907 - RNA, 22 nt, Homo sapiens
acucacuuugaaguccauucug

SEQ ID NO: 7908 - RNA, 22 nt, Homo sapiens
cucacuuugaaguccauucugc

SEQ ID NO: 7909 - RNA, 22 nt, Homo sapiens
ucacuuugaaguccauucugca

SEQ ID NO: 7910 - RNA, 22 nt, Homo sapiens
cacuuugaaguccauucugcag

SEQ ID NO: 7911 - RNA, 22 nt, Homo sapiens
acuuugaaguccauucugcaga

SEQ ID NO: 7912 - RNA, 22 nt, Homo sapiens
cuuugaaguccauucugcagaa

SEQ ID NO: 7913 - RNA, 22 nt, Homo sapiens
uuugaaguccauucugcagaau

SEQ ID NO: 7914 - RNA, 22 nt, Homo sapiens
uugaaguccauucugcagaauc

SEQ ID NO: 7915 - RNA, 22 nt, Homo sapiens
ugaaguccauucugcagaaucu

SEQ ID NO: 7916 - RNA, 22 nt, Homo sapiens
gaaguccauucugcagaaucuu

SEQ ID NO: 7917 - RNA, 22 nt, Homo sapiens
aaguccauucugcagaaucuuc

SEQ ID NO: 7918 - RNA, 22 nt, Homo sapiens
aguccauucugcagaaucuucc

SEQ ID NO: 7919 - RNA, 22 nt, Homo sapiens
guccauucugcagaaucuuccu

SEQ ID NO: 7920 - RNA, 22 nt, Homo sapiens
uccauucugcagaaucuuccuu

SEQ ID NO: 7921 - RNA, 22 nt, Homo sapiens
ccauucugcagaaucuuccuuc

SEQ ID NO: 7922 - RNA, 22 nt, Homo sapiens
cauucugcagaaucuuccuuca

SEQ ID NO: 7923 - RNA, 22 nt, Homo sapiens
auucugcagaaucuuccuucau

SEQ ID NO: 7924 - RNA, 22 nt, Homo sapiens
uucugcagaaucuuccuucauc

SEQ ID NO: 7925 - RNA, 22 nt, Homo sapiens
ucugcagaaucuuccuucauca

SEQ ID NO: 7926 - RNA, 22 nt, Homo sapiens
cugcagaaucuuccuucaucaa

SEQ ID NO: 7927 - RNA, 22 nt, Homo sapiens
ugcagaaucuuccuucaucaau

SEQ ID NO: 7928 - RNA, 22 nt, Homo sapiens
gcagaaucuuccuucaucaauc

SEQ ID NO: 7929 - RNA, 22 nt, Homo sapiens
cagaaucuuccuucaucaaucg

SEQ ID NO: 7930 - RNA, 22 nt, Homo sapiens
agaaucuuccuucaucaaucga

SEQ ID NO: 7931 - RNA, 22 nt, Homo sapiens
gaaucuuccuucaucaaucgac

SEQ ID NO: 7932 - RNA, 22 nt, Homo sapiens
aaucuuccuucaucaaucgaca

SEQ ID NO: 7933 - RNA, 22 nt, Homo sapiens
aucuuccuucaucaaucgacau

SEQ ID NO: 7934 - RNA, 22 nt, Homo sapiens
ucuuccuucaucaaucgacaug

SEQ ID NO: 7935 - RNA, 22 nt, Homo sapiens
cuuccuucaucaaucgacaugu

SEQ ID NO: 7936 - RNA, 22 nt, Homo sapiens
uuccuucaucaaucgacauguu

SEQ ID NO: 7937 - RNA, 22 nt, Homo sapiens
uccuucaucaaucgacauguuc

SEQ ID NO: 7938 - RNA, 22 nt, Homo sapiens
ccuucaucaaucgacauguucu

SEQ ID NO: 7939 - RNA, 22 nt, Homo sapiens
cuucaucaaucgacauguucuc

SEQ ID NO: 7940 - RNA, 22 nt, Homo sapiens
uucaucaaucgacauguucucu

SEQ ID NO: 7941 - RNA, 22 nt, Homo sapiens
ucaucaaucgacauguucucug

SEQ ID NO: 7942 - RNA, 22 nt, Homo sapiens
caucaaucgacauguucucugg

SEQ ID NO: 7943 - RNA, 22 nt, Homo sapiens
aucaaucgacauguucucuggc

SEQ ID NO: 7944 - RNA, 22 nt, Homo sapiens
ucaaucgacauguucucuggca

SEQ ID NO: 7945 - RNA, 22 nt, Homo sapiens
caaucgacauguucucuggcac

SEQ ID NO: 7946 - RNA, 22 nt, Homo sapiens
aaucgacauguucucuggcacu

SEQ ID NO: 7947 - RNA, 22 nt, Homo sapiens
aucgacauguucucuggcacuu

SEQ ID NO: 7948 - RNA, 22 nt, Homo sapiens
ucgacauguucucuggcacuug

SEQ ID NO: 7949 - RNA, 22 nt, Homo sapiens
cgacauguucucuggcacuuga

SEQ ID NO: 7950 - RNA, 22 nt, Homo sapiens
gacauguucucuggcacuugaa

SEQ ID NO: 7951 - RNA, 22 nt, Homo sapiens
acauguucucuggcacuugaau

SEQ ID NO: 7952 - RNA, 22 nt, Homo sapiens
cauguucucuggcacuugaaug

SEQ ID NO: 7953 - RNA, 22 nt, Homo sapiens
auguucucuggcacuugaauga

SEQ ID NO: 7954 - RNA, 22 nt, Homo sapiens
uguucucuggcacuugaaugaa

SEQ ID NO: 7955 - RNA, 22 nt, Homo sapiens
guucucuggcacuugaaugaaa

SEQ ID NO: 7956 - RNA, 22 nt, Homo sapiens
uucucuggcacuugaaugaaac

SEQ ID NO: 7957 - RNA, 22 nt, Homo sapiens
ucucuggcacuugaaugaaacg

SEQ ID NO: 7958 - RNA, 22 nt, Homo sapiens
cucuggcacuugaaugaaacgu

SEQ ID NO: 7959 - RNA, 22 nt, Homo sapiens
ucuggcacuugaaugaaacgug

SEQ ID NO: 7960 - RNA, 22 nt, Homo sapiens
cuggcacuugaaugaaacgugg

SEQ ID NO: 7961 - RNA, 22 nt, Homo sapiens
uggcacuugaaugaaacguggu

SEQ ID NO: 7962 - RNA, 22 nt, Homo sapiens
ggcacuugaaugaaacguggug

SEQ ID NO: 7963 - RNA, 22 nt, Homo sapiens
gcacuugaaugaaacguggugg

SEQ ID NO: 7964 - RNA, 22 nt, Homo sapiens
cacuugaaugaaacgugguggg

SEQ ID NO: 7965 - RNA, 22 nt, Homo sapiens
acuugaaugaaacguggugggu

SEQ ID NO: 7966 - RNA, 22 nt, Homo sapiens
cuugaaugaaacguggugggua

SEQ ID NO: 7967 - RNA, 22 nt, Homo sapiens
uugaaugaaacgugguggguaa

SEQ ID NO: 7968 - RNA, 22 nt, Homo sapiens
ugaaugaaacgugguggguaaa

SEQ ID NO: 7969 - RNA, 22 nt, Homo sapiens
gaaugaaacgugguggguaaaa

SEQ ID NO: 7970 - RNA, 22 nt, Homo sapiens
aaugaaacgugguggguaaaau

SEQ ID NO: 7971 - RNA, 22 nt, Homo sapiens
augaaacgugguggguaaaauu

SEQ ID NO: 7972 - RNA, 22 nt, Homo sapiens
ugaaacgugguggguaaaauuu

SEQ ID NO: 7973 - RNA, 22 nt, Homo sapiens
gaaacgugguggguaaaauuuc

SEQ ID NO: 7974 - RNA, 22 nt, Homo sapiens
aaacgugguggguaaaauuucu

SEQ ID NO: 7975 - RNA, 22 nt, Homo sapiens
aacgugguggguaaaauuucuc

SEQ ID NO: 7976 - RNA, 22 nt, Homo sapiens
acgugguggguaaaauuucucc

SEQ ID NO: 7977 - RNA, 22 nt, Homo sapiens
cgugguggguaaaauuucuccu

SEQ ID NO: 7978 - RNA, 22 nt, Homo sapiens
gugguggguaaaauuucuccug

SEQ ID NO: 7979 - RNA, 22 nt, Homo sapiens
ugguggguaaaauuucuccugg

SEQ ID NO: 7980 - RNA, 22 nt, Homo sapiens
gguggguaaaauuucuccugga

SEQ ID NO: 7981 - RNA, 22 nt, Homo sapiens
guggguaaaauuucuccuggau

SEQ ID NO: 7982 - RNA, 22 nt, Homo sapiens
uggguaaaauuucuccuggauu

SEQ ID NO: 7983 - RNA, 22 nt, Homo sapiens
ggguaaaauuucuccuggauug

SEQ ID NO: 7984 - RNA, 22 nt, Homo sapiens
gguaaaauuucuccuggauugc

SEQ ID NO: 7985 - RNA, 22 nt, Homo sapiens
guaaaauuucuccuggauugca

SEQ ID NO: 7986 - RNA, 22 nt, Homo sapiens
uaaaauuucuccuggauugcau

SEQ ID NO: 7987 - RNA, 22 nt, Homo sapiens
aaaauuucuccuggauugcauc

SEQ ID NO: 7988 - RNA, 22 nt, Homo sapiens
aaauuucuccuggauugcaucc

SEQ ID NO: 7989 - RNA, 22 nt, Homo sapiens
aauuucuccuggauugcauccu

SEQ ID NO: 7990 - RNA, 22 nt, Homo sapiens
auuucuccuggauugcauccug

SEQ ID NO: 7991 - RNA, 22 nt, Homo sapiens
uuucuccuggauugcauccuga

SEQ ID NO: 7992 - RNA, 22 nt, Homo sapiens
uucuccuggauugcauccugau

SEQ ID NO: 7993 - RNA, 22 nt, Homo sapiens
ucuccuggauugcauccugauc

SEQ ID NO: 7994 - RNA, 22 nt, Homo sapiens
cuccuggauugcauccugauca

SEQ ID NO: 7995 - RNA, 22 nt, Homo sapiens
uccuggauugcauccugaucau

SEQ ID NO: 7996 - RNA, 22 nt, Homo sapiens
ccuggauugcauccugaucauu

SEQ ID NO: 7997 - RNA, 22 nt, Homo sapiens
cuggauugcauccugaucauuc

SEQ ID NO: 7998 - RNA, 22 nt, Homo sapiens
uggauugcauccugaucauuca

SEQ ID NO: 7999 - RNA, 22 nt, Homo sapiens
ggauugcauccugaucauucac

SEQ ID NO: 8000 - RNA, 22 nt, Homo sapiens
gauugcauccugaucauucaca

SEQ ID NO: 8001 - RNA, 22 nt, Homo sapiens
auugcauccugaucauucacau

SEQ ID NO: 8002 - RNA, 22 nt, Homo sapiens
uugcauccugaucauucacauc

SEQ ID NO: 8003 - RNA, 22 nt, Homo sapiens
ugcauccugaucauucacaucu

SEQ ID NO: 8004 - RNA, 22 nt, Homo sapiens
gcauccugaucauucacaucuc

SEQ ID NO: 8005 - RNA, 22 nt, Homo sapiens
cauccugaucauucacaucucc

SEQ ID NO: 8006 - RNA, 22 nt, Homo sapiens
auccugaucauucacaucuccc

SEQ ID NO: 8007 - RNA, 22 nt, Homo sapiens
uccugaucauucacaucucccc

SEQ ID NO: 8008 - RNA, 22 nt, Homo sapiens
ccugaucauucacaucuccccu

SEQ ID NO: 8009 - RNA, 22 nt, Homo sapiens
cugaucauucacaucuccccuu

SEQ ID NO: 8010 - RNA, 22 nt, Homo sapiens
ugaucauucacaucuccccuug

SEQ ID NO: 8011 - RNA, 22 nt, Homo sapiens
gaucauucacaucuccccuuga

SEQ ID NO: 8012 - RNA, 22 nt, Homo sapiens
aucauucacaucuccccuugag

SEQ ID NO: 8013 - RNA, 22 nt, Homo sapiens
ucauucacaucuccccuugagg

SEQ ID NO: 8014 - RNA, 22 nt, Homo sapiens
cauucacaucuccccuugaggu

SEQ ID NO: 8015 - RNA, 22 nt, Homo sapiens
auucacaucuccccuugagguu

SEQ ID NO: 8016 - RNA, 22 nt, Homo sapiens
uucacaucuccccuugagguug

SEQ ID NO: 8017 - RNA, 22 nt, Homo sapiens
ucacaucuccccuugagguuga

SEQ ID NO: 8018 - RNA, 22 nt, Homo sapiens
cacaucuccccuugagguugau

SEQ ID NO: 8019 - RNA, 22 nt, Homo sapiens
acaucuccccuugagguugauc

SEQ ID NO: 8020 - RNA, 22 nt, Homo sapiens
caucuccccuugagguugaucu

SEQ ID NO: 8021 - RNA, 22 nt, Homo sapiens
aucuccccuugagguugaucua

SEQ ID NO: 8022 - RNA, 22 nt, Homo sapiens
ucuccccuugagguugaucuac

SEQ ID NO: 8023 - RNA, 22 nt, Homo sapiens
cuccccuugagguugaucuacu

SEQ ID NO: 8024 - RNA, 22 nt, Homo sapiens
uccccuugagguugaucuacuu

SEQ ID NO: 8025 - RNA, 22 nt, Homo sapiens
ccccuugagguugaucuacuuc

SEQ ID NO: 8026 - RNA, 22 nt, Homo sapiens
cccuugagguugaucuacuucu

SEQ ID NO: 8027 - RNA, 22 nt, Homo sapiens
ccuugagguugaucuacuucuu

SEQ ID NO: 8028 - RNA, 22 nt, Homo sapiens
cuugagguugaucuacuucuua

SEQ ID NO: 8029 - RNA, 22 nt, Homo sapiens
uugagguugaucuacuucuuac

SEQ ID NO: 8030 - RNA, 22 nt, Homo sapiens
ugagguugaucuacuucuuacu

SEQ ID NO: 8031 - RNA, 22 nt, Homo sapiens
gagguugaucuacuucuuacuu

SEQ ID NO: 8032 - RNA, 22 nt, Homo sapiens
agguugaucuacuucuuacuug

SEQ ID NO: 8033 - RNA, 22 nt, Homo sapiens
gguugaucuacuucuuacuugu

SEQ ID NO: 8034 - RNA, 22 nt, Homo sapiens
guugaucuacuucuuacuugug

SEQ ID NO: 8035 - RNA, 22 nt, Homo sapiens
uugaucuacuucuuacuuguga

SEQ ID NO: 8036 - RNA, 22 nt, Homo sapiens
ugaucuacuucuuacuugugau

SEQ ID NO: 8037 - RNA, 22 nt, Homo sapiens
gaucuacuucuuacuugugaug

SEQ ID NO: 8038 - RNA, 22 nt, Homo sapiens
aucuacuucuuacuugugaugu

SEQ ID NO: 8039 - RNA, 22 nt, Homo sapiens
ucuacuucuuacuugugaugua

SEQ ID NO: 8040 - RNA, 22 nt, Homo sapiens
cuacuucuuacuugugauguag

SEQ ID NO: 8041 - RNA, 22 nt, Homo sapiens
uacuucuuacuugugauguagg

SEQ ID NO: 8042 - RNA, 22 nt, Homo sapiens
acuucuuacuugugauguagga

SEQ ID NO: 8043 - RNA, 22 nt, Homo sapiens
cuucuuacuugugauguaggaa

SEQ ID NO: 8044 - RNA, 22 nt, Homo sapiens
uucuuacuugugauguaggaac

SEQ ID NO: 8045 - RNA, 22 nt, Homo sapiens
ucuuacuugugauguaggaacu

SEQ ID NO: 8046 - RNA, 22 nt, Homo sapiens
cuuacuugugauguaggaacuu

SEQ ID NO: 8047 - RNA, 22 nt, Homo sapiens
uuacuugugauguaggaacuug

SEQ ID NO: 8048 - RNA, 22 nt, Homo sapiens
uacuugugauguaggaacuugc

SEQ ID NO: 8049 - RNA, 22 nt, Homo sapiens
acuugugauguaggaacuugca

SEQ ID NO: 8050 - RNA, 22 nt, Homo sapiens
cuugugauguaggaacuugcag

SEQ ID NO: 8051 - RNA, 22 nt, Homo sapiens
uugugauguaggaacuugcagu

SEQ ID NO: 8052 - RNA, 22 nt, Homo sapiens
ugugauguaggaacuugcaguc

SEQ ID NO: 8053 - RNA, 22 nt, Homo sapiens
gugauguaggaacuugcagucg

SEQ ID NO: 8054 - RNA, 22 nt, Homo sapiens
ugauguaggaacuugcagucgc

SEQ ID NO: 8055 - RNA, 22 nt, Homo sapiens
gauguaggaacuugcagucgcg

SEQ ID NO: 8056 - RNA, 22 nt, Homo sapiens
auguaggaacuugcagucgcgc

SEQ ID NO: 8057 - RNA, 22 nt, Homo sapiens
uguaggaacuugcagucgcgca

SEQ ID NO: 8058 - RNA, 22 nt, Homo sapiens
guaggaacuugcagucgcgcau

SEQ ID NO: 8059 - RNA, 22 nt, Homo sapiens
uaggaacuugcagucgcgcaug

SEQ ID NO: 8060 - RNA, 22 nt, Homo sapiens
aggaacuugcagucgcgcaugu

SEQ ID NO: 8061 - RNA, 22 nt, Homo sapiens
ggaacuugcagucgcgcauguu

SEQ ID NO: 8062 - RNA, 22 nt, Homo sapiens
gaacuugcagucgcgcauguuc

SEQ ID NO: 8063 - RNA, 22 nt, Homo sapiens
aacuugcagucgcgcauguucu

SEQ ID NO: 8064 - RNA, 22 nt, Homo sapiens
acuugcagucgcgcauguucug

SEQ ID NO: 8065 - RNA, 22 nt, Homo sapiens
cuugcagucgcgcauguucuga

SEQ ID NO: 8066 - RNA, 22 nt, Homo sapiens
uugcagucgcgcauguucugag

SEQ ID NO: 8067 - RNA, 22 nt, Homo sapiens
ugcagucgcgcauguucugagu

SEQ ID NO: 8068 - RNA, 22 nt, Homo sapiens
gcagucgcgcauguucugaguu

SEQ ID NO: 8069 - RNA, 22 nt, Homo sapiens
cagucgcgcauguucugaguug

SEQ ID NO: 8070 - RNA, 22 nt, Homo sapiens
agucgcgcauguucugaguugu

SEQ ID NO: 8071 - RNA, 22 nt, Homo sapiens
gucgcgcauguucugaguugug

SEQ ID NO: 8072 - RNA, 22 nt, Homo sapiens
ucgcgcauguucugaguugugu

SEQ ID NO: 8073 - RNA, 22 nt, Homo sapiens
cgcgcauguucugaguuguguu

SEQ ID NO: 8074 - RNA, 22 nt, Homo sapiens
gcgcauguucugaguuguguug

SEQ ID NO: 8075 - RNA, 22 nt, Homo sapiens
cgcauguucugaguuguguugc

SEQ ID NO: 8076 - RNA, 22 nt, Homo sapiens
gcauguucugaguuguguugcu

SEQ ID NO: 8077 - RNA, 22 nt, Homo sapiens
cauguucugaguuguguugcug

SEQ ID NO: 8078 - RNA, 22 nt, Homo sapiens
auguucugaguuguguugcugc

SEQ ID NO: 8079 - RNA, 22 nt, Homo sapiens
uguucugaguuguguugcugcg

SEQ ID NO: 8080 - RNA, 22 nt, Homo sapiens
guucugaguuguguugcugcga

SEQ ID NO: 8081 - RNA, 22 nt, Homo sapiens
uucugaguuguguugcugcgag

SEQ ID NO: 8082 - RNA, 22 nt, Homo sapiens
ucugaguuguguugcugcgagu

SEQ ID NO: 8083 - RNA, 22 nt, Homo sapiens
cugaguuguguugcugcgaguc

SEQ ID NO: 8084 - RNA, 22 nt, Homo sapiens
ugaguuguguugcugcgagucu

SEQ ID NO: 8085 - RNA, 22 nt, Homo sapiens
gaguuguguugcugcgagucuu

SEQ ID NO: 8086 - RNA, 22 nt, Homo sapiens
aguuguguugcugcgagucuug

SEQ ID NO: 8087 - RNA, 22 nt, Homo sapiens
guuguguugcugcgagucuugu

SEQ ID NO: 8088 - RNA, 22 nt, Homo sapiens
uuguguugcugcgagucuugug

SEQ ID NO: 8089 - RNA, 22 nt, Homo sapiens
uguguugcugcgagucuugugc

SEQ ID NO: 8090 - RNA, 22 nt, Homo sapiens
guguugcugcgagucuugugca

SEQ ID NO: 8091 - RNA, 22 nt, Homo sapiens
uguugcugcgagucuugugcac

SEQ ID NO: 8092 - RNA, 22 nt, Homo sapiens
guugcugcgagucuugugcacc

SEQ ID NO: 8093 - RNA, 22 nt, Homo sapiens
uugcugcgagucuugugcacca

SEQ ID NO: 8094 - RNA, 22 nt, Homo sapiens
ugcugcgagucuugugcaccac

SEQ ID NO: 8095 - RNA, 22 nt, Homo sapiens
gcugcgagucuugugcaccacu

SEQ ID NO: 8096 - RNA, 22 nt, Homo sapiens
cugcgagucuugugcaccacug

SEQ ID NO: 8097 - RNA, 22 nt, Homo sapiens
ugcgagucuugugcaccacugu

SEQ ID NO: 8098 - RNA, 22 nt, Homo sapiens
gcgagucuugugcaccacuguc

SEQ ID NO: 8099 - RNA, 22 nt, Homo sapiens
cgagucuugugcaccacuguca

SEQ ID NO: 8100 - RNA, 22 nt, Homo sapiens
gagucuugugcaccacugucau

SEQ ID NO: 8101 - RNA, 22 nt, Homo sapiens
agucuugugcaccacugucauc

SEQ ID NO: 8102 - RNA, 22 nt, Homo sapiens
gucuugugcaccacugucaucc

SEQ ID NO: 8103 - RNA, 22 nt, Homo sapiens
ucuugugcaccacugucauccu

SEQ ID NO: 8104 - RNA, 22 nt, Homo sapiens
cuugugcaccacugucauccug

SEQ ID NO: 8105 - RNA, 22 nt, Homo sapiens
uugugcaccacugucauccuga

SEQ ID NO: 8106 - RNA, 22 nt, Homo sapiens
ugugcaccacugucauccugag

SEQ ID NO: 8107 - RNA, 22 nt, Homo sapiens
gugcaccacugucauccugagc

SEQ ID NO: 8108 - RNA, 22 nt, Homo sapiens
ugcaccacugucauccugagcu

SEQ ID NO: 8109 - RNA, 22 nt, Homo sapiens
gcaccacugucauccugagcuu

SEQ ID NO: 8110 - RNA, 22 nt, Homo sapiens
caccacugucauccugagcuug

SEQ ID NO: 8111 - RNA, 22 nt, Homo sapiens
accacugucauccugagcuuga

SEQ ID NO: 8112 - RNA, 22 nt, Homo sapiens
ccacugucauccugagcuugaa

SEQ ID NO: 8113 - RNA, 22 nt, Homo sapiens
cacugucauccugagcuugaaa

SEQ ID NO: 8114 - RNA, 22 nt, Homo sapiens
acugucauccugagcuugaaac

SEQ ID NO: 8115 - RNA, 22 nt, Homo sapiens
cugucauccugagcuugaaaca

SEQ ID NO: 8116 - RNA, 22 nt, Homo sapiens
ugucauccugagcuugaaacac

SEQ ID NO: 8117 - RNA, 22 nt, Homo sapiens
gucauccugagcuugaaacaca

SEQ ID NO: 8118 - RNA, 22 nt, Homo sapiens
ucauccugagcuugaaacacag

SEQ ID NO: 8119 - RNA, 22 nt, Homo sapiens
cauccugagcuugaaacacagc

SEQ ID NO: 8120 - RNA, 22 nt, Homo sapiens
auccugagcuugaaacacagca

SEQ ID NO: 8121 - RNA, 22 nt, Homo sapiens
uccugagcuugaaacacagcag

SEQ ID NO: 8122 - RNA, 22 nt, Homo sapiens
ccugagcuugaaacacagcagc

SEQ ID NO: 8123 - RNA, 22 nt, Homo sapiens
cugagcuugaaacacagcagcu

SEQ ID NO: 8124 - RNA, 22 nt, Homo sapiens
ugagcuugaaacacagcagcug

SEQ ID NO: 8125 - RNA, 22 nt, Homo sapiens
gagcuugaaacacagcagcugc

SEQ ID NO: 8126 - RNA, 22 nt, Homo sapiens
agcuugaaacacagcagcugca

SEQ ID NO: 8127 - RNA, 22 nt, Homo sapiens
gcuugaaacacagcagcugcau

SEQ ID NO: 8128 - RNA, 22 nt, Homo sapiens
cuugaaacacagcagcugcauu

SEQ ID NO: 8129 - RNA, 22 nt, Homo sapiens
uugaaacacagcagcugcauuc

SEQ ID NO: 8130 - RNA, 22 nt, Homo sapiens
ugaaacacagcagcugcauucu

SEQ ID NO: 8131 - RNA, 22 nt, Homo sapiens
gaaacacagcagcugcauucug

SEQ ID NO: 8132 - RNA, 22 nt, Homo sapiens
aaacacagcagcugcauucugu

SEQ ID NO: 8133 - RNA, 22 nt, Homo sapiens
aacacagcagcugcauucugug

SEQ ID NO: 8134 - RNA, 22 nt, Homo sapiens
acacagcagcugcauucugugg

SEQ ID NO: 8135 - RNA, 22 nt, Homo sapiens
cacagcagcugcauucuguggu

SEQ ID NO: 8136 - RNA, 22 nt, Homo sapiens
acagcagcugcauucugugguc

SEQ ID NO: 8137 - RNA, 22 nt, Homo sapiens
cagcagcugcauucuguggucc

SEQ ID NO: 8138 - RNA, 22 nt, Homo sapiens
agcagcugcauucugugguccu

SEQ ID NO: 8139 - RNA, 22 nt, Homo sapiens
gcagcugcauucugugguccua

SEQ ID NO: 8140 - RNA, 22 nt, Homo sapiens
cagcugcauucugugguccuag

SEQ ID NO: 8141 - RNA, 22 nt, Homo sapiens
agcugcauucugugguccuagc

SEQ ID NO: 8142 - RNA, 22 nt, Homo sapiens
gcugcauucugugguccuagca

SEQ ID NO: 8143 - RNA, 22 nt, Homo sapiens
cugcauucugugguccuagcaa

SEQ ID NO: 8144 - RNA, 22 nt, Homo sapiens
ugcauucugugguccuagcaau

SEQ ID NO: 8145 - RNA, 22 nt, Homo sapiens
gcauucugugguccuagcaauc

SEQ ID NO: 8146 - RNA, 22 nt, Homo sapiens
cauucugugguccuagcaaucu

SEQ ID NO: 8147 - RNA, 22 nt, Homo sapiens
auucugugguccuagcaaucug

SEQ ID NO: 8148 - RNA, 22 nt, Homo sapiens
uucugugguccuagcaaucugc

SEQ ID NO: 8149 - RNA, 22 nt, Homo sapiens
ucugugguccuagcaaucugcg

SEQ ID NO: 8150 - RNA, 22 nt, Homo sapiens
cugugguccuagcaaucugcga

SEQ ID NO: 8151 - RNA, 22 nt, Homo sapiens
ugugguccuagcaaucugcgag

SEQ ID NO: 8152 - RNA, 22 nt, Homo sapiens
gugguccuagcaaucugcgagc

SEQ ID NO: 8153 - RNA, 22 nt, Homo sapiens
ugguccuagcaaucugcgagcc

SEQ ID NO: 8154 - RNA, 22 nt, Homo sapiens
gguccuagcaaucugcgagcca

SEQ ID NO: 8155 - RNA, 22 nt, Homo sapiens
guccuagcaaucugcgagccau

SEQ ID NO: 8156 - RNA, 22 nt, Homo sapiens
uccuagcaaucugcgagccauc

SEQ ID NO: 8157 - RNA, 22 nt, Homo sapiens
ccuagcaaucugcgagccaucu

SEQ ID NO: 8158 - RNA, 22 nt, Homo sapiens
cuagcaaucugcgagccaucuu

SEQ ID NO: 8159 - RNA, 22 nt, Homo sapiens
uagcaaucugcgagccaucuuc

SEQ ID NO: 8160 - RNA, 22 nt, Homo sapiens
agcaaucugcgagccaucuucu

SEQ ID NO: 8161 - RNA, 22 nt, Homo sapiens
gcaaucugcgagccaucuucuc

SEQ ID NO: 8162 - RNA, 22 nt, Homo sapiens
caaucugcgagccaucuucucu

SEQ ID NO: 8163 - RNA, 22 nt, Homo sapiens
aaucugcgagccaucuucucuu

SEQ ID NO: 8164 - RNA, 22 nt, Homo sapiens
aucugcgagccaucuucucuuc

SEQ ID NO: 8165 - RNA, 22 nt, Homo sapiens
ucugcgagccaucuucucuuca

SEQ ID NO: 8166 - RNA, 22 nt, Homo sapiens
cugcgagccaucuucucuucau

SEQ ID NO: 8167 - RNA, 22 nt, Homo sapiens
ugcgagccaucuucucuucaua

SEQ ID NO: 8168 - RNA, 22 nt, Homo sapiens
gcgagccaucuucucuucauau

SEQ ID NO: 8169 - RNA, 22 nt, Homo sapiens
cgagccaucuucucuucauaug

SEQ ID NO: 8170 - RNA, 22 nt, Homo sapiens
gagccaucuucucuucauaugu

SEQ ID NO: 8171 - RNA, 22 nt, Homo sapiens
agccaucuucucuucauauguu

SEQ ID NO: 8172 - RNA, 22 nt, Homo sapiens
gccaucuucucuucauauguua

SEQ ID NO: 8173 - RNA, 22 nt, Homo sapiens
ccaucuucucuucauauguuag

SEQ ID NO: 8174 - RNA, 22 nt, Homo sapiens
caucuucucuucauauguuaga

SEQ ID NO: 8175 - RNA, 22 nt, Homo sapiens
aucuucucuucauauguuagac

SEQ ID NO: 8176 - RNA, 22 nt, Homo sapiens
ucuucucuucauauguuagacg

SEQ ID NO: 8177 - RNA, 22 nt, Homo sapiens
cuucucuucauauguuagacgu

SEQ ID NO: 8178 - RNA, 22 nt, Homo sapiens
uucucuucauauguuagacguu

SEQ ID NO: 8179 - RNA, 22 nt, Homo sapiens
ucucuucauauguuagacguug

SEQ ID NO: 8180 - RNA, 22 nt, Homo sapiens
cucuucauauguuagacguuga

SEQ ID NO: 8181 - RNA, 22 nt, Homo sapiens
ucuucauauguuagacguugau

SEQ ID NO: 8182 - RNA, 22 nt, Homo sapiens
cuucauauguuagacguugauu

SEQ ID NO: 8183 - RNA, 22 nt, Homo sapiens
uucauauguuagacguugauuu

SEQ ID NO: 8184 - RNA, 22 nt, Homo sapiens
ucauauguuagacguugauuuc

SEQ ID NO: 8185 - RNA, 22 nt, Homo sapiens
cauauguuagacguugauuucc

SEQ ID NO: 8186 - RNA, 22 nt, Homo sapiens
auauguuagacguugauuucca

SEQ ID NO: 8187 - RNA, 22 nt, Homo sapiens
uauguuagacguugauuuccau

SEQ ID NO: 8188 - RNA, 22 nt, Homo sapiens
auguuagacguugauuuccauu

SEQ ID NO: 8189 - RNA, 22 nt, Homo sapiens
uguuagacguugauuuccauua

SEQ ID NO: 8190 - RNA, 22 nt, Homo sapiens
guuagacguugauuuccauuau

SEQ ID NO: 8191 - RNA, 22 nt, Homo sapiens
uuagacguugauuuccauuaug

SEQ ID NO: 8192 - RNA, 22 nt, Homo sapiens
uagacguugauuuccauuauga

SEQ ID NO: 8193 - RNA, 22 nt, Homo sapiens
agacguugauuuccauuaugaa

SEQ ID NO: 8194 - RNA, 22 nt, Homo sapiens
gacguugauuuccauuaugaag

SEQ ID NO: 8195 - RNA, 22 nt, Homo sapiens
acguugauuuccauuaugaaga

SEQ ID NO: 8196 - RNA, 22 nt, Homo sapiens
cguugauuuccauuaugaagaa

SEQ ID NO: 8197 - RNA, 22 nt, Homo sapiens
guugauuuccauuaugaagaag

SEQ ID NO: 8198 - RNA, 22 nt, Homo sapiens
uugauuuccauuaugaagaagg

SEQ ID NO: 8199 - RNA, 22 nt, Homo sapiens
ugauuuccauuaugaagaaggg

SEQ ID NO: 8200 - RNA, 22 nt, Homo sapiens
gauuuccauuaugaagaagggu

SEQ ID NO: 8201 - RNA, 22 nt, Homo sapiens
auuuccauuaugaagaagggug

SEQ ID NO: 8202 - RNA, 22 nt, Homo sapiens
uuuccauuaugaagaagggugu

SEQ ID NO: 8203 - RNA, 22 nt, Homo sapiens
uuccauuaugaagaaggguguc

SEQ ID NO: 8204 - RNA, 22 nt, Homo sapiens
uccauuaugaagaagggugucc

SEQ ID NO: 8205 - RNA, 22 nt, Homo sapiens
ccauuaugaagaaggguguccu

SEQ ID NO: 8206 - RNA, 22 nt, Homo sapiens
cauuaugaagaaggguguccuu

SEQ ID NO: 8207 - RNA, 22 nt, Homo sapiens
auuaugaagaaggguguccuug

SEQ ID NO: 8208 - RNA, 22 nt, Homo sapiens
uuaugaagaaggguguccuugc

SEQ ID NO: 8209 - RNA, 22 nt, Homo sapiens
uaugaagaaggguguccuugca

SEQ ID NO: 8210 - RNA, 22 nt, Homo sapiens
augaagaaggguguccuugcau

SEQ ID NO: 8211 - RNA, 22 nt, Homo sapiens
ugaagaaggguguccuugcauu

SEQ ID NO: 8212 - RNA, 22 nt, Homo sapiens
gaagaaggguguccuugcauuu

SEQ ID NO: 8213 - RNA, 22 nt, Homo sapiens
aagaaggguguccuugcauuuc

SEQ ID NO: 8214 - RNA, 22 nt, Homo sapiens
agaaggguguccuugcauuuca

SEQ ID NO: 8215 - RNA, 22 nt, Homo sapiens
gaaggguguccuugcauuucag

SEQ ID NO: 8216 - RNA, 22 nt, Homo sapiens
aaggguguccuugcauuucagc

SEQ ID NO: 8217 - RNA, 22 nt, Homo sapiens
aggguguccuugcauuucagcu

SEQ ID NO: 8218 - RNA, 22 nt, Homo sapiens
ggguguccuugcauuucagcuu

SEQ ID NO: 8219 - RNA, 22 nt, Homo sapiens
gguguccuugcauuucagcuuu

SEQ ID NO: 8220 - RNA, 22 nt, Homo sapiens
guguccuugcauuucagcuuuc

SEQ ID NO: 8221 - RNA, 22 nt, Homo sapiens
uguccuugcauuucagcuuucu

SEQ ID NO: 8222 - RNA, 22 nt, Homo sapiens
guccuugcauuucagcuuucuu

SEQ ID NO: 8223 - RNA, 22 nt, Homo sapiens
uccuugcauuucagcuuucuuu

SEQ ID NO: 8224 - RNA, 22 nt, Homo sapiens
ccuugcauuucagcuuucuuuc

SEQ ID NO: 8225 - RNA, 22 nt, Homo sapiens
cuugcauuucagcuuucuuucc

SEQ ID NO: 8226 - RNA, 22 nt, Homo sapiens
uugcauuucagcuuucuuucca

SEQ ID NO: 8227 - RNA, 22 nt, Homo sapiens
ugcauuucagcuuucuuuccaa

SEQ ID NO: 8228 - RNA, 22 nt, Homo sapiens
gcauuucagcuuucuuuccaaa

SEQ ID NO: 8229 - RNA, 22 nt, Homo sapiens
cauuucagcuuucuuuccaaau

SEQ ID NO: 8230 - RNA, 22 nt, Homo sapiens
auuucagcuuucuuuccaaauc

SEQ ID NO: 8231 - RNA, 22 nt, Homo sapiens
uuucagcuuucuuuccaaaucu

SEQ ID NO: 8232 - RNA, 22 nt, Homo sapiens
uucagcuuucuuuccaaaucuu

SEQ ID NO: 8233 - RNA, 22 nt, Homo sapiens
ucagcuuucuuuccaaaucuug

SEQ ID NO: 8234 - RNA, 22 nt, Homo sapiens
cagcuuucuuuccaaaucuuga

SEQ ID NO: 8235 - RNA, 22 nt, Homo sapiens
agcuuucuuuccaaaucuugaa

SEQ ID NO: 8236 - RNA, 22 nt, Homo sapiens
gcuuucuuuccaaaucuugaau

SEQ ID NO: 8237 - RNA, 22 nt, Homo sapiens
cuuucuuuccaaaucuugaauc

SEQ ID NO: 8238 - RNA, 22 nt, Homo sapiens
uuucuuuccaaaucuugaauca

SEQ ID NO: 8239 - RNA, 22 nt, Homo sapiens
uucuuuccaaaucuugaaucaa

SEQ ID NO: 8240 - RNA, 22 nt, Homo sapiens
ucuuuccaaaucuugaaucaaa

SEQ ID NO: 8241 - RNA, 22 nt, Homo sapiens
cuuuccaaaucuugaaucaaag

SEQ ID NO: 8242 - RNA, 22 nt, Homo sapiens
uuuccaaaucuugaaucaaagc

SEQ ID NO: 8243 - RNA, 22 nt, Homo sapiens
uuccaaaucuugaaucaaagcu

SEQ ID NO: 8244 - RNA, 22 nt, Homo sapiens
uccaaaucuugaaucaaagcuu

SEQ ID NO: 8245 - RNA, 22 nt, Homo sapiens
ccaaaucuugaaucaaagcuuc

SEQ ID NO: 8246 - RNA, 22 nt, Homo sapiens
caaaucuugaaucaaagcuucu

SEQ ID NO: 8247 - RNA, 22 nt, Homo sapiens
aaaucuugaaucaaagcuucuu

SEQ ID NO: 8248 - RNA, 22 nt, Homo sapiens
aaucuugaaucaaagcuucuuu

SEQ ID NO: 8249 - RNA, 22 nt, Homo sapiens
aucuugaaucaaagcuucuuuu

SEQ ID NO: 8250 - RNA, 22 nt, Homo sapiens
ucuugaaucaaagcuucuuuug

SEQ ID NO: 8251 - RNA, 22 nt, Homo sapiens
cuugaaucaaagcuucuuuuga

SEQ ID NO: 8252 - RNA, 22 nt, Homo sapiens
uugaaucaaagcuucuuuugau

SEQ ID NO: 8253 - RNA, 22 nt, Homo sapiens
ugaaucaaagcuucuuuugauc

SEQ ID NO: 8254 - RNA, 22 nt, Homo sapiens
gaaucaaagcuucuuuugaucc

SEQ ID NO: 8255 - RNA, 22 nt, Homo sapiens
aaucaaagcuucuuuugauccu

SEQ ID NO: 8256 - RNA, 22 nt, Homo sapiens
aucaaagcuucuuuugauccuu

SEQ ID NO: 8257 - RNA, 22 nt, Homo sapiens
ucaaagcuucuuuugauccuug

SEQ ID NO: 8258 - RNA, 22 nt, Homo sapiens
caaagcuucuuuugauccuugu

SEQ ID NO: 8259 - RNA, 22 nt, Homo sapiens
aaagcuucuuuugauccuugua

SEQ ID NO: 8260 - RNA, 22 nt, Homo sapiens
aagcuucuuuugauccuuguau

SEQ ID NO: 8261 - RNA, 22 nt, Homo sapiens
agcuucuuuugauccuuguauu

SEQ ID NO: 8262 - RNA, 22 nt, Homo sapiens
gcuucuuuugauccuuguauuu

SEQ ID NO: 8263 - RNA, 22 nt, Homo sapiens
cuucuuuugauccuuguauuuc

SEQ ID NO: 8264 - RNA, 22 nt, Homo sapiens
uucuuuugauccuuguauuuca

SEQ ID NO: 8265 - RNA, 22 nt, Homo sapiens
ucuuuugauccuuguauuucau

SEQ ID NO: 8266 - RNA, 22 nt, Homo sapiens
cuuuugauccuuguauuucaug

SEQ ID NO: 8267 - RNA, 22 nt, Homo sapiens
uuuugauccuuguauuucauga

SEQ ID NO: 8268 - RNA, 22 nt, Homo sapiens
uuugauccuuguauuucaugau

SEQ ID NO: 8269 - RNA, 22 nt, Homo sapiens
uugauccuuguauuucaugauc

SEQ ID NO: 8270 - RNA, 22 nt, Homo sapiens
ugauccuuguauuucaugauca

SEQ ID NO: 8271 - RNA, 22 nt, Homo sapiens
gauccuuguauuucaugaucag

SEQ ID NO: 8272 - RNA, 22 nt, Homo sapiens
auccuuguauuucaugaucagg

SEQ ID NO: 8273 - RNA, 22 nt, Homo sapiens
uccuuguauuucaugaucagga

SEQ ID NO: 8274 - RNA, 22 nt, Homo sapiens
ccuuguauuucaugaucaggag

SEQ ID NO: 8275 - RNA, 22 nt, Homo sapiens
cuuguauuucaugaucaggagu

SEQ ID NO: 8276 - RNA, 22 nt, Homo sapiens
uuguauuucaugaucaggaguu

SEQ ID NO: 8277 - RNA, 22 nt, Homo sapiens
uguauuucaugaucaggaguuc

SEQ ID NO: 8278 - RNA, 22 nt, Homo sapiens
guauuucaugaucaggaguucu

SEQ ID NO: 8279 - RNA, 22 nt, Homo sapiens
uauuucaugaucaggaguucuu

SEQ ID NO: 8280 - RNA, 22 nt, Homo sapiens
auuucaugaucaggaguucuug

SEQ ID NO: 8281 - RNA, 22 nt, Homo sapiens
uuucaugaucaggaguucuugg

SEQ ID NO: 8282 - RNA, 22 nt, Homo sapiens
uucaugaucaggaguucuuggu

SEQ ID NO: 8283 - RNA, 22 nt, Homo sapiens
ucaugaucaggaguucuuggua

SEQ ID NO: 8284 - RNA, 22 nt, Homo sapiens
caugaucaggaguucuugguau

SEQ ID NO: 8285 - RNA, 22 nt, Homo sapiens
augaucaggaguucuugguaug

SEQ ID NO: 8286 - RNA, 22 nt, Homo sapiens
ugaucaggaguucuugguaugg

SEQ ID NO: 8287 - RNA, 22 nt, Homo sapiens
gaucaggaguucuugguauggg

SEQ ID NO: 8288 - RNA, 22 nt, Homo sapiens
aucaggaguucuugguaugggc

SEQ ID NO: 8289 - RNA, 22 nt, Homo sapiens
ucaggaguucuugguaugggcu

SEQ ID NO: 8290 - RNA, 22 nt, Homo sapiens
caggaguucuugguaugggcuu

SEQ ID NO: 8291 - RNA, 22 nt, Homo sapiens
aggaguucuugguaugggcuua

SEQ ID NO: 8292 - RNA, 22 nt, Homo sapiens
ggaguucuugguaugggcuuag

SEQ ID NO: 8293 - RNA, 22 nt, Homo sapiens
gaguucuugguaugggcuuagc

SEQ ID NO: 8294 - RNA, 22 nt, Homo sapiens
aguucuugguaugggcuuagca

SEQ ID NO: 8295 - RNA, 22 nt, Homo sapiens
guucuugguaugggcuuagcau

SEQ ID NO: 8296 - RNA, 22 nt, Homo sapiens
uucuugguaugggcuuagcauu

SEQ ID NO: 8297 - RNA, 22 nt, Homo sapiens
ucuugguaugggcuuagcauuu

SEQ ID NO: 8298 - RNA, 22 nt, Homo sapiens
cuugguaugggcuuagcauuug

SEQ ID NO: 8299 - RNA, 22 nt, Homo sapiens
uugguaugggcuuagcauuugc

SEQ ID NO: 8300 - RNA, 22 nt, Homo sapiens
ugguaugggcuuagcauuugca

SEQ ID NO: 8301 - RNA, 22 nt, Homo sapiens
gguaugggcuuagcauuugcag

SEQ ID NO: 8302 - RNA, 22 nt, Homo sapiens
guaugggcuuagcauuugcagu

SEQ ID NO: 8303 - RNA, 22 nt, Homo sapiens
uaugggcuuagcauuugcaguu

SEQ ID NO: 8304 - RNA, 22 nt, Homo sapiens
augggcuuagcauuugcaguuu

SEQ ID NO: 8305 - RNA, 22 nt, Homo sapiens
ugggcuuagcauuugcaguuug

SEQ ID NO: 8306 - RNA, 22 nt, Homo sapiens
gggcuuagcauuugcaguuugg

SEQ ID NO: 8307 - RNA, 22 nt, Homo sapiens
ggcuuagcauuugcaguuuggg

SEQ ID NO: 8308 - RNA, 22 nt, Homo sapiens
gcuuagcauuugcaguuuggga

SEQ ID NO: 8309 - RNA, 22 nt, Homo sapiens
cuuagcauuugcaguuugggau

SEQ ID NO: 8310 - RNA, 22 nt, Homo sapiens
uuagcauuugcaguuugggaug

SEQ ID NO: 8311 - RNA, 22 nt, Homo sapiens
uagcauuugcaguuugggaugg

SEQ ID NO: 8312 - RNA, 22 nt, Homo sapiens
agcauuugcaguuugggauggc

SEQ ID NO: 8313 - RNA, 22 nt, Homo sapiens
gcauuugcaguuugggauggcu

SEQ ID NO: 8314 - RNA, 22 nt, Homo sapiens
cauuugcaguuugggauggcuu

SEQ ID NO: 8315 - RNA, 22 nt, Homo sapiens
auuugcaguuugggauggcuuu

SEQ ID NO: 8316 - RNA, 22 nt, Homo sapiens
uuugcaguuugggauggcuuug

SEQ ID NO: 8317 - RNA, 22 nt, Homo sapiens
uugcaguuugggauggcuuugc

SEQ ID NO: 8318 - RNA, 22 nt, Homo sapiens
ugcaguuugggauggcuuugca

SEQ ID NO: 8319 - RNA, 22 nt, Homo sapiens
gcaguuugggauggcuuugcau

SEQ ID NO: 8320 - RNA, 22 nt, Homo sapiens
caguuugggauggcuuugcauu

SEQ ID NO: 8321 - RNA, 22 nt, Homo sapiens
aguuugggauggcuuugcauuu

SEQ ID NO: 8322 - RNA, 22 nt, Homo sapiens
guuugggauggcuuugcauuua

SEQ ID NO: 8323 - RNA, 22 nt, Homo sapiens
uuugggauggcuuugcauuuau

SEQ ID NO: 8324 - RNA, 22 nt, Homo sapiens
uugggauggcuuugcauuuaua

SEQ ID NO: 8325 - RNA, 22 nt, Homo sapiens
ugggauggcuuugcauuuauag

SEQ ID NO: 8326 - RNA, 22 nt, Homo sapiens
gggauggcuuugcauuuauagg

SEQ ID NO: 8327 - RNA, 22 nt, Homo sapiens
ggauggcuuugcauuuauaggu

SEQ ID NO: 8328 - RNA, 22 nt, Homo sapiens
gauggcuuugcauuuauagguu

SEQ ID NO: 8329 - RNA, 22 nt, Homo sapiens
auggcuuugcauuuauagguug

SEQ ID NO: 8330 - RNA, 22 nt, Homo sapiens
uggcuuugcauuuauagguugg

SEQ ID NO: 8331 - RNA, 22 nt, Homo sapiens
ggcuuugcauuuauagguuggc

SEQ ID NO: 8332 - RNA, 22 nt, Homo sapiens
gcuuugcauuuauagguuggcc

SEQ ID NO: 8333 - RNA, 22 nt, Homo sapiens
cuuugcauuuauagguuggcca

SEQ ID NO: 8334 - RNA, 22 nt, Homo sapiens
uuugcauuuauagguuggccag

SEQ ID NO: 8335 - RNA, 22 nt, Homo sapiens
uugcauuuauagguuggccagc

SEQ ID NO: 8336 - RNA, 22 nt, Homo sapiens
ugcauuuauagguuggccagcu

SEQ ID NO: 8337 - RNA, 22 nt, Homo sapiens
gcauuuauagguuggccagcug

SEQ ID NO: 8338 - RNA, 22 nt, Homo sapiens
cauuuauagguuggccagcuga

SEQ ID NO: 8339 - RNA, 22 nt, Homo sapiens
auuuauagguuggccagcugag

SEQ ID NO: 8340 - RNA, 22 nt, Homo sapiens
uuuauagguuggccagcugagg

SEQ ID NO: 8341 - RNA, 22 nt, Homo sapiens
uuauagguuggccagcugagga

SEQ ID NO: 8342 - RNA, 22 nt, Homo sapiens
uauagguuggccagcugaggac

SEQ ID NO: 8343 - RNA, 22 nt, Homo sapiens
auagguuggccagcugaggacu

SEQ ID NO: 8344 - RNA, 22 nt, Homo sapiens
uagguuggccagcugaggacug

SEQ ID NO: 8345 - RNA, 22 nt, Homo sapiens
agguuggccagcugaggacugu

SEQ ID NO: 8346 - RNA, 22 nt, Homo sapiens
gguuggccagcugaggacuguu

SEQ ID NO: 8347 - RNA, 22 nt, Homo sapiens
guuggccagcugaggacuguug

SEQ ID NO: 8348 - RNA, 22 nt, Homo sapiens
uuggccagcugaggacuguuga

SEQ ID NO: 8349 - RNA, 22 nt, Homo sapiens
uggccagcugaggacuguugau

SEQ ID NO: 8350 - RNA, 22 nt, Homo sapiens
ggccagcugaggacuguugaua

SEQ ID NO: 8351 - RNA, 22 nt, Homo sapiens
gccagcugaggacuguugauag

SEQ ID NO: 8352 - RNA, 22 nt, Homo sapiens
ccagcugaggacuguugauagu

SEQ ID NO: 8353 - RNA, 22 nt, Homo sapiens
cagcugaggacuguugauaguu

SEQ ID NO: 8354 - RNA, 22 nt, Homo sapiens
agcugaggacuguugauaguug

SEQ ID NO: 8355 - RNA, 22 nt, Homo sapiens
gcugaggacuguugauaguugg

SEQ ID NO: 8356 - RNA, 22 nt, Homo sapiens
cugaggacuguugauaguugga

SEQ ID NO: 8357 - RNA, 22 nt, Homo sapiens
ugaggacuguugauaguuggaa

SEQ ID NO: 8358 - RNA, 22 nt, Homo sapiens
gaggacuguugauaguuggaau

SEQ ID NO: 8359 - RNA, 22 nt, Homo sapiens
aggacuguugauaguuggaauc

SEQ ID NO: 8360 - RNA, 22 nt, Homo sapiens
ggacuguugauaguuggaaucc

SEQ ID NO: 8361 - RNA, 22 nt, Homo sapiens
gacuguugauaguuggaaucca

SEQ ID NO: 8362 - RNA, 22 nt, Homo sapiens
acuguugauaguuggaauccau

SEQ ID NO: 8363 - RNA, 22 nt, Homo sapiens
cuguugauaguuggaauccaua

SEQ ID NO: 8364 - RNA, 22 nt, Homo sapiens
uguugauaguuggaauccauag

SEQ ID NO: 8365 - RNA, 22 nt, Homo sapiens
guugauaguuggaauccauagc

SEQ ID NO: 8366 - RNA, 22 nt, Homo sapiens
uugauaguuggaauccauagcg

SEQ ID NO: 8367 - RNA, 22 nt, Homo sapiens
ugauaguuggaauccauagcgg

SEQ ID NO: 8368 - RNA, 22 nt, Homo sapiens
gauaguuggaauccauagcgga

SEQ ID NO: 8369 - RNA, 22 nt, Homo sapiens
auaguuggaauccauagcggaa

SEQ ID NO: 8370 - RNA, 22 nt, Homo sapiens
uaguuggaauccauagcggaag

SEQ ID NO: 8371 - RNA, 22 nt, Homo sapiens
aguuggaauccauagcggaagg

SEQ ID NO: 8372 - RNA, 22 nt, Homo sapiens
guuggaauccauagcggaaggg

SEQ ID NO: 8373 - RNA, 22 nt, Homo sapiens
uuggaauccauagcggaaggga

SEQ ID NO: 8374 - RNA, 22 nt, Homo sapiens
uggaauccauagcggaagggau

SEQ ID NO: 8375 - RNA, 22 nt, Homo sapiens
ggaauccauagcggaagggauu

SEQ ID NO: 8376 - RNA, 22 nt, Homo sapiens
gaauccauagcggaagggauuu

SEQ ID NO: 8377 - RNA, 22 nt, Homo sapiens
aauccauagcggaagggauuuu

SEQ ID NO: 8378 - RNA, 22 nt, Homo sapiens
auccauagcggaagggauuuua

SEQ ID NO: 8379 - RNA, 22 nt, Homo sapiens
uccauagcggaagggauuuuac

SEQ ID NO: 8380 - RNA, 22 nt, Homo sapiens
ccauagcggaagggauuuuacu

SEQ ID NO: 8381 - RNA, 22 nt, Homo sapiens
cauagcggaagggauuuuacug

SEQ ID NO: 8382 - RNA, 22 nt, Homo sapiens
auagcggaagggauuuuacugc

SEQ ID NO: 8383 - RNA, 22 nt, Homo sapiens
uagcggaagggauuuuacugcu

SEQ ID NO: 8384 - RNA, 22 nt, Homo sapiens
agcggaagggauuuuacugcua

SEQ ID NO: 8385 - RNA, 22 nt, Homo sapiens
gcggaagggauuuuacugcuau

SEQ ID NO: 8386 - RNA, 22 nt, Homo sapiens
cggaagggauuuuacugcuauu

SEQ ID NO: 8387 - RNA, 22 nt, Homo sapiens
ggaagggauuuuacugcuauug

SEQ ID NO: 8388 - RNA, 22 nt, Homo sapiens
gaagggauuuuacugcuauugu

SEQ ID NO: 8389 - RNA, 22 nt, Homo sapiens
aagggauuuuacugcuauugua

SEQ ID NO: 8390 - RNA, 22 nt, Homo sapiens
agggauuuuacugcuauuguaa

SEQ ID NO: 8391 - RNA, 22 nt, Homo sapiens
gggauuuuacugcuauuguaau

SEQ ID NO: 8392 - RNA, 22 nt, Homo sapiens
ggauuuuacugcuauuguaauc

SEQ ID NO: 8393 - RNA, 22 nt, Homo sapiens
gauuuuacugcuauuguaauca

SEQ ID NO: 8394 - RNA, 22 nt, Homo sapiens
auuuuacugcuauuguaaucag

SEQ ID NO: 8395 - RNA, 22 nt, Homo sapiens
uuuuacugcuauuguaaucagg

SEQ ID NO: 8396 - RNA, 22 nt, Homo sapiens
uuuacugcuauuguaaucaggc

SEQ ID NO: 8397 - RNA, 22 nt, Homo sapiens
uuacugcuauuguaaucaggcu

SEQ ID NO: 8398 - RNA, 22 nt, Homo sapiens
uacugcuauuguaaucaggcug

SEQ ID NO: 8399 - RNA, 22 nt, Homo sapiens
acugcuauuguaaucaggcugu

SEQ ID NO: 8400 - RNA, 22 nt, Homo sapiens
cugcuauuguaaucaggcugug

SEQ ID NO: 8401 - RNA, 22 nt, Homo sapiens
ugcuauuguaaucaggcuguga

SEQ ID NO: 8402 - RNA, 22 nt, Homo sapiens
gcuauuguaaucaggcugugau

SEQ ID NO: 8403 - RNA, 22 nt, Homo sapiens
cuauuguaaucaggcugugaug

SEQ ID NO: 8404 - RNA, 22 nt, Homo sapiens
uauuguaaucaggcugugaugg

SEQ ID NO: 8405 - RNA, 22 nt, Homo sapiens
auuguaaucaggcugugauggu

SEQ ID NO: 8406 - RNA, 22 nt, Homo sapiens
uuguaaucaggcugugauggua

SEQ ID NO: 8407 - RNA, 22 nt, Homo sapiens
uguaaucaggcugugaugguaa

SEQ ID NO: 8408 - RNA, 22 nt, Homo sapiens
guaaucaggcugugaugguaau

SEQ ID NO: 8409 - RNA, 22 nt, Homo sapiens
uaaucaggcugugaugguaaua

SEQ ID NO: 8410 - RNA, 22 nt, Homo sapiens
aaucaggcugugaugguaauau

SEQ ID NO: 8411 - RNA, 22 nt, Homo sapiens
aucaggcugugaugguaauaug

SEQ ID NO: 8412 - RNA, 22 nt, Homo sapiens
ucaggcugugaugguaauaugg

SEQ ID NO: 8413 - RNA, 22 nt, Homo sapiens
caggcugugaugguaauaugga

SEQ ID NO: 8414 - RNA, 22 nt, Homo sapiens
aggcugugaugguaauauggag

SEQ ID NO: 8415 - RNA, 22 nt, Homo sapiens
ggcugugaugguaauauggagc

SEQ ID NO: 8416 - RNA, 22 nt, Homo sapiens
gcugugaugguaauauggagcu

SEQ ID NO: 8417 - RNA, 22 nt, Homo sapiens
cugugaugguaauauggagcug

SEQ ID NO: 8418 - RNA, 22 nt, Homo sapiens
ugugaugguaauauggagcuga

SEQ ID NO: 8419 - RNA, 22 nt, Homo sapiens
gugaugguaauauggagcugag

SEQ ID NO: 8420 - RNA, 22 nt, Homo sapiens
ugaugguaauauggagcugagg

SEQ ID NO: 8421 - RNA, 22 nt, Homo sapiens
gaugguaauauggagcugagga

SEQ ID NO: 8422 - RNA, 22 nt, Homo sapiens
augguaauauggagcugaggaa

SEQ ID NO: 8423 - RNA, 22 nt, Homo sapiens
ugguaauauggagcugaggaag

SEQ ID NO: 8424 - RNA, 22 nt, Homo sapiens
gguaauauggagcugaggaagc

SEQ ID NO: 8425 - RNA, 22 nt, Homo sapiens
guaauauggagcugaggaagcu

SEQ ID NO: 8426 - RNA, 22 nt, Homo sapiens
uaauauggagcugaggaagcug

SEQ ID NO: 8427 - RNA, 22 nt, Homo sapiens
aauauggagcugaggaagcugg

SEQ ID NO: 8428 - RNA, 22 nt, Homo sapiens
auauggagcugaggaagcuggc

SEQ ID NO: 8429 - RNA, 22 nt, Homo sapiens
uauggagcugaggaagcuggcu

SEQ ID NO: 8430 - RNA, 22 nt, Homo sapiens
auggagcugaggaagcuggcug

SEQ ID NO: 8431 - RNA, 22 nt, Homo sapiens
uggagcugaggaagcuggcugg

SEQ ID NO: 8432 - RNA, 22 nt, Homo sapiens
ggagcugaggaagcuggcuggg

SEQ ID NO: 8433 - RNA, 22 nt, Homo sapiens
gagcugaggaagcuggcugggg

SEQ ID NO: 8434 - RNA, 22 nt, Homo sapiens
agcugaggaagcuggcugggga

SEQ ID NO: 8435 - RNA, 22 nt, Homo sapiens
gcugaggaagcuggcuggggac

SEQ ID NO: 8436 - RNA, 22 nt, Homo sapiens
cugaggaagcuggcuggggacu

SEQ ID NO: 8437 - RNA, 22 nt, Homo sapiens
ugaggaagcuggcuggggacug

SEQ ID NO: 8438 - RNA, 22 nt, Homo sapiens
gaggaagcuggcuggggacugg

SEQ ID NO: 8439 - RNA, 22 nt, Homo sapiens
aggaagcuggcuggggacuggu

SEQ ID NO: 8440 - RNA, 22 nt, Homo sapiens
ggaagcuggcuggggacugguu

SEQ ID NO: 8441 - RNA, 22 nt, Homo sapiens
gaagcuggcuggggacugguua

SEQ ID NO: 8442 - RNA, 22 nt, Homo sapiens
aagcuggcuggggacugguuau

SEQ ID NO: 8443 - RNA, 22 nt, Homo sapiens
agcuggcuggggacugguuaua

SEQ ID NO: 8444 - RNA, 22 nt, Homo sapiens
gcuggcuggggacugguuauag

SEQ ID NO: 8445 - RNA, 22 nt, Homo sapiens
cuggcuggggacugguuauagg

SEQ ID NO: 8446 - RNA, 22 nt, Homo sapiens
uggcuggggacugguuauaggu

SEQ ID NO: 8447 - RNA, 22 nt, Homo sapiens
ggcuggggacugguuauaggug

SEQ ID NO: 8448 - RNA, 22 nt, Homo sapiens
gcuggggacugguuauaggugg

SEQ ID NO: 8449 - RNA, 22 nt, Homo sapiens
cuggggacugguuauagguggu

SEQ ID NO: 8450 - RNA, 22 nt, Homo sapiens
uggggacugguuauaggugguu

SEQ ID NO: 8451 - RNA, 22 nt, Homo sapiens
ggggacugguuauaggugguug

SEQ ID NO: 8452 - RNA, 22 nt, Homo sapiens
gggacugguuauaggugguugu

SEQ ID NO: 8453 - RNA, 22 nt, Homo sapiens
ggacugguuauaggugguugua

SEQ ID NO: 8454 - RNA, 22 nt, Homo sapiens
gacugguuauaggugguuguaa

SEQ ID NO: 8455 - RNA, 22 nt, Homo sapiens
acugguuauaggugguuguaac

SEQ ID NO: 8456 - RNA, 22 nt, Homo sapiens
cugguuauaggugguuguaacc

SEQ ID NO: 8457 - RNA, 22 nt, Homo sapiens
ugguuauaggugguuguaaccc

SEQ ID NO: 8458 - RNA, 22 nt, Homo sapiens
gguuauaggugguuguaacccu

SEQ ID NO: 8459 - RNA, 22 nt, Homo sapiens
guuauaggugguuguaacccuu

SEQ ID NO: 8460 - RNA, 22 nt, Homo sapiens
uuauaggugguuguaacccuuu

SEQ ID NO: 8461 - RNA, 22 nt, Homo sapiens
uauaggugguuguaacccuuug

SEQ ID NO: 8462 - RNA, 22 nt, Homo sapiens
auaggugguuguaacccuuugg

SEQ ID NO: 8463 - RNA, 22 nt, Homo sapiens
uaggugguuguaacccuuuggc

SEQ ID NO: 8464 - RNA, 22 nt, Homo sapiens
aggugguuguaacccuuuggcc

SEQ ID NO: 8465 - RNA, 22 nt, Homo sapiens
ggugguuguaacccuuuggccu

SEQ ID NO: 8466 - RNA, 22 nt, Homo sapiens
gugguuguaacccuuuggccug

SEQ ID NO: 8467 - RNA, 22 nt, Homo sapiens
ugguuguaacccuuuggccugg

SEQ ID NO: 8468 - RNA, 22 nt, Homo sapiens
gguuguaacccuuuggccuggg

SEQ ID NO: 8469 - RNA, 22 nt, Homo sapiens
guuguaacccuuuggccugggu

SEQ ID NO: 8470 - RNA, 22 nt, Homo sapiens
uuguaacccuuuggccuggguu

SEQ ID NO: 8471 - RNA, 22 nt, Homo sapiens
uguaacccuuuggccuggguug

SEQ ID NO: 8472 - RNA, 22 nt, Homo sapiens
guaacccuuuggccuggguugg

SEQ ID NO: 8473 - RNA, 22 nt, Homo sapiens
uaacccuuuggccuggguugga

SEQ ID NO: 8474 - RNA, 22 nt, Homo sapiens
aacccuuuggccuggguuggag

SEQ ID NO: 8475 - RNA, 22 nt, Homo sapiens
acccuuuggccuggguuggagc

SEQ ID NO: 8476 - RNA, 22 nt, Homo sapiens
cccuuuggccuggguuggagcc

SEQ ID NO: 8477 - RNA, 22 nt, Homo sapiens
ccuuuggccuggguuggagcca

SEQ ID NO: 8478 - RNA, 22 nt, Homo sapiens
cuuuggccuggguuggagccag

SEQ ID NO: 8479 - RNA, 22 nt, Homo sapiens
uuuggccuggguuggagccagc

SEQ ID NO: 8480 - RNA, 22 nt, Homo sapiens
uuggccuggguuggagccagca

SEQ ID NO: 8481 - RNA, 22 nt, Homo sapiens
uggccuggguuggagccagcau

SEQ ID NO: 8482 - RNA, 22 nt, Homo sapiens
ggccuggguuggagccagcaug

SEQ ID NO: 8483 - RNA, 22 nt, Homo sapiens
gccuggguuggagccagcaugc

SEQ ID NO: 8484 - RNA, 22 nt, Homo sapiens
ccuggguuggagccagcaugcu

SEQ ID NO: 8485 - RNA, 22 nt, Homo sapiens
cuggguuggagccagcaugcug

SEQ ID NO: 8486 - RNA, 22 nt, Homo sapiens
uggguuggagccagcaugcugc

SEQ ID NO: 8487 - RNA, 22 nt, Homo sapiens
ggguuggagccagcaugcugcu

SEQ ID NO: 8488 - RNA, 22 nt, Homo sapiens
gguuggagccagcaugcugcug

SEQ ID NO: 8489 - RNA, 22 nt, Homo sapiens
guuggagccagcaugcugcugg

SEQ ID NO: 8490 - RNA, 22 nt, Homo sapiens
uuggagccagcaugcugcuggg

SEQ ID NO: 8491 - RNA, 22 nt, Homo sapiens
uggagccagcaugcugcugggg

SEQ ID NO: 8492 - RNA, 22 nt, Homo sapiens
ggagccagcaugcugcugggga

SEQ ID NO: 8493 - RNA, 22 nt, Homo sapiens
gagccagcaugcugcuggggag

SEQ ID NO: 8494 - RNA, 22 nt, Homo sapiens
agccagcaugcugcuggggaga

SEQ ID NO: 8495 - RNA, 22 nt, Homo sapiens
gccagcaugcugcuggggagaa

SEQ ID NO: 8496 - RNA, 22 nt, Homo sapiens
ccagcaugcugcuggggagaag

SEQ ID NO: 8497 - RNA, 22 nt, Homo sapiens
cagcaugcugcuggggagaagc

SEQ ID NO: 8498 - RNA, 22 nt, Homo sapiens
agcaugcugcuggggagaagca

SEQ ID NO: 8499 - RNA, 22 nt, Homo sapiens
gcaugcugcuggggagaagcag

SEQ ID NO: 8500 - RNA, 22 nt, Homo sapiens
caugcugcuggggagaagcagg

SEQ ID NO: 8501 - RNA, 22 nt, Homo sapiens
augcugcuggggagaagcaggg

SEQ ID NO: 8502 - RNA, 22 nt, Homo sapiens
ugcugcuggggagaagcaggga

SEQ ID NO: 8503 - RNA, 22 nt, Homo sapiens
gcugcuggggagaagcagggaa

SEQ ID NO: 8504 - RNA, 22 nt, Homo sapiens
cugcuggggagaagcagggaaa

SEQ ID NO: 8505 - RNA, 22 nt, Homo sapiens
ugcuggggagaagcagggaaag

SEQ ID NO: 8506 - RNA, 22 nt, Homo sapiens
gcuggggagaagcagggaaagc

SEQ ID NO: 8507 - RNA, 22 nt, Homo sapiens
cuggggagaagcagggaaagca

SEQ ID NO: 8508 - RNA, 22 nt, Homo sapiens
uggggagaagcagggaaagcag

SEQ ID NO: 8509 - RNA, 22 nt, Homo sapiens
ggggagaagcagggaaagcaga

SEQ ID NO: 8510 - RNA, 22 nt, Homo sapiens
gggagaagcagggaaagcagag

SEQ ID NO: 8511 - RNA, 22 nt, Homo sapiens
ggagaagcagggaaagcagagg

SEQ ID NO: 8512 - RNA, 22 nt, Homo sapiens
gagaagcagggaaagcagagga

SEQ ID NO: 8513 - RNA, 22 nt, Homo sapiens
agaagcagggaaagcagaggag

SEQ ID NO: 8514 - RNA, 22 nt, Homo sapiens
gaagcagggaaagcagaggagg

SEQ ID NO: 8515 - RNA, 22 nt, Homo sapiens
aagcagggaaagcagaggagga

SEQ ID NO: 8516 - RNA, 22 nt, Homo sapiens
agcagggaaagcagaggaggac

SEQ ID NO: 8517 - RNA, 22 nt, Homo sapiens
gcagggaaagcagaggaggaca

SEQ ID NO: 8518 - RNA, 22 nt, Homo sapiens
cagggaaagcagaggaggacau

SEQ ID NO: 8519 - RNA, 22 nt, Homo sapiens
agggaaagcagaggaggacaug

SEQ ID NO: 8520 - RNA, 22 nt, Homo sapiens
gggaaagcagaggaggacaugg

SEQ ID NO: 8521 - RNA, 22 nt, Homo sapiens
ggaaagcagaggaggacauggu

SEQ ID NO: 8522 - RNA, 22 nt, Homo sapiens
gaaagcagaggaggacauggug

SEQ ID NO: 8523 - RNA, 22 nt, Homo sapiens
aaagcagaggaggacaugguga

SEQ ID NO: 8524 - RNA, 22 nt, Homo sapiens
aagcagaggaggacauggugau

SEQ ID NO: 8525 - RNA, 22 nt, Homo sapiens
agcagaggaggacauggugaug

SEQ ID NO: 8526 - RNA, 22 nt, Homo sapiens
gcagaggaggacauggugaugu

SEQ ID NO: 8527 - RNA, 22 nt, Homo sapiens
cagaggaggacauggugaugug

SEQ ID NO: 8528 - RNA, 22 nt, Homo sapiens
agaggaggacauggugauguga

SEQ ID NO: 8529 - RNA, 22 nt, Homo sapiens
gaggaggacauggugaugugag

SEQ ID NO: 8530 - RNA, 22 nt, Homo sapiens
aggaggacauggugaugugaga

SEQ ID NO: 8531 - RNA, 22 nt, Homo sapiens
ggaggacauggugaugugagag

SEQ ID NO: 8532 - RNA, 22 nt, Homo sapiens
gaggacauggugaugugagagc

SEQ ID NO: 8533 - RNA, 22 nt, Homo sapiens
aggacauggugaugugagagcu

SEQ ID NO: 8534 - RNA, 22 nt, Homo sapiens
ggacauggugaugugagagcuc

SEQ ID NO: 8535 - RNA, 22 nt, Homo sapiens
gacauggugaugugagagcuca

SEQ ID NO: 8536 - RNA, 22 nt, Homo sapiens
acauggugaugugagagcucag

SEQ ID NO: 8537 - RNA, 22 nt, Homo sapiens
cauggugaugugagagcucagu

SEQ ID NO: 8538 - RNA, 22 nt, Homo sapiens
auggugaugugagagcucagug

SEQ ID NO: 8539 - RNA, 22 nt, Homo sapiens
uggugaugugagagcucagugu

SEQ ID NO: 8540 - RNA, 22 nt, Homo sapiens
ggugaugugagagcucaguguu

SEQ ID NO: 8541 - RNA, 22 nt, Homo sapiens
gugaugugagagcucaguguug

SEQ ID NO: 8542 - RNA, 22 nt, Homo sapiens
ugaugugagagcucaguguuga

SEQ ID NO: 8543 - RNA, 22 nt, Homo sapiens
gaugugagagcucaguguugag

SEQ ID NO: 8544 - RNA, 22 nt, Homo sapiens
augugagagcucaguguugagg

SEQ ID NO: 8545 - RNA, 22 nt, Homo sapiens
ugugagagcucaguguugagga

SEQ ID NO: 8546 - RNA, 22 nt, Homo sapiens
gugagagcucaguguugaggag

SEQ ID NO: 8547 - RNA, 22 nt, Homo sapiens
ugagagcucaguguugaggagg

SEQ ID NO: 8548 - RNA, 22 nt, Homo sapiens
gagagcucaguguugaggaggc

SEQ ID NO: 8549 - RNA, 22 nt, Homo sapiens
agagcucaguguugaggaggca

SEQ ID NO: 8550 - RNA, 22 nt, Homo sapiens
gagcucaguguugaggaggcag

SEQ ID NO: 8551 - RNA, 22 nt, Homo sapiens
agcucaguguugaggaggcaga

SEQ ID NO: 8552 - RNA, 22 nt, Homo sapiens
gcucaguguugaggaggcagaa

SEQ ID NO: 8553 - RNA, 22 nt, Homo sapiens
cucaguguugaggaggcagaaa

SEQ ID NO: 8554 - RNA, 22 nt, Homo sapiens
ucaguguugaggaggcagaaaa

SEQ ID NO: 8555 - RNA, 22 nt, Homo sapiens
caguguugaggaggcagaaaau

SEQ ID NO: 8556 - RNA, 22 nt, Homo sapiens
aguguugaggaggcagaaaauc

SEQ ID NO: 8557 - RNA, 22 nt, Homo sapiens
guguugaggaggcagaaaaucu

SEQ ID NO: 8558 - RNA, 22 nt, Homo sapiens
uguugaggaggcagaaaaucuu

SEQ ID NO: 8559 - RNA, 22 nt, Homo sapiens
guugaggaggcagaaaaucuuu

SEQ ID NO: 8560 - RNA, 22 nt, Homo sapiens
uugaggaggcagaaaaucuuug

SEQ ID NO: 8561 - RNA, 22 nt, Homo sapiens
ugaggaggcagaaaaucuuugc

SEQ ID NO: 8562 - RNA, 22 nt, Homo sapiens
gaggaggcagaaaaucuuugcu

SEQ ID NO: 8563 - RNA, 22 nt, Homo sapiens
aggaggcagaaaaucuuugcuc

SEQ ID NO: 8564 - RNA, 22 nt, Homo sapiens
ggaggcagaaaaucuuugcucu

SEQ ID NO: 8565 - RNA, 22 nt, Homo sapiens
gaggcagaaaaucuuugcucug

SEQ ID NO: 8566 - RNA, 22 nt, Homo sapiens
aggcagaaaaucuuugcucugu

SEQ ID NO: 8567 - RNA, 22 nt, Homo sapiens
ggcagaaaaucuuugcucugua

SEQ ID NO: 8568 - RNA, 22 nt, Homo sapiens
gcagaaaaucuuugcucuguac

SEQ ID NO: 8569 - RNA, 22 nt, Homo sapiens
cagaaaaucuuugcucuguaca

SEQ ID NO: 8570 - RNA, 22 nt, Homo sapiens
agaaaaucuuugcucuguacac

SEQ ID NO: 8571 - RNA, 22 nt, Homo sapiens
gaaaaucuuugcucuguacacu

SEQ ID NO: 8572 - RNA, 22 nt, Homo sapiens
aaaaucuuugcucuguacacug

SEQ ID NO: 8573 - RNA, 22 nt, Homo sapiens
aaaucuuugcucuguacacugg

SEQ ID NO: 8574 - RNA, 22 nt, Homo sapiens
aaucuuugcucuguacacuggc

SEQ ID NO: 8575 - RNA, 22 nt, Homo sapiens
aucuuugcucuguacacuggcg

SEQ ID NO: 8576 - RNA, 22 nt, Homo sapiens
ucuuugcucuguacacuggcgg

SEQ ID NO: 8577 - RNA, 22 nt, Homo sapiens
cuuugcucuguacacuggcggg

SEQ ID NO: 8578 - RNA, 22 nt, Homo sapiens
uuugcucuguacacuggcgggg

SEQ ID NO: 8579 - RNA, 22 nt, Homo sapiens
uugcucuguacacuggcggggc

SEQ ID NO: 8580 - RNA, 22 nt, Homo sapiens
ugcucuguacacuggcggggcu

SEQ ID NO: 8581 - RNA, 22 nt, Homo sapiens
gcucuguacacuggcggggcug

SEQ ID NO: 8582 - RNA, 22 nt, Homo sapiens
cucuguacacuggcggggcugg

SEQ ID NO: 8583 - RNA, 22 nt, Homo sapiens
ucuguacacuggcggggcugga

SEQ ID NO: 8584 - RNA, 22 nt, Homo sapiens
cuguacacuggcggggcuggau

SEQ ID NO: 8585 - RNA, 22 nt, Homo sapiens
uguacacuggcggggcuggaug

SEQ ID NO: 8586 - RNA, 22 nt, Homo sapiens
guacacuggcggggcuggauga

SEQ ID NO: 8587 - RNA, 22 nt, Homo sapiens
uacacuggcggggcuggaugau

SEQ ID NO: 8588 - RNA, 22 nt, Homo sapiens
acacuggcggggcuggaugaua

SEQ ID NO: 8589 - RNA, 22 nt, Homo sapiens
cacuggcggggcuggaugauaa

SEQ ID NO: 8590 - RNA, 22 nt, Homo sapiens
acuggcggggcuggaugauaau

SEQ ID NO: 8591 - RNA, 22 nt, Homo sapiens
cuggcggggcuggaugauaaug

SEQ ID NO: 8592 - RNA, 22 nt, Homo sapiens
uggcggggcuggaugauaaugg

SEQ ID NO: 8593 - RNA, 22 nt, Homo sapiens
ggcggggcuggaugauaaugga

SEQ ID NO: 8594 - RNA, 22 nt, Homo sapiens
gcggggcuggaugauaauggaa

SEQ ID NO: 8595 - RNA, 22 nt, Homo sapiens
cggggcuggaugauaauggaag

SEQ ID NO: 8596 - RNA, 22 nt, Homo sapiens
ggggcuggaugauaauggaaga

SEQ ID NO: 8597 - RNA, 22 nt, Homo sapiens
gggcuggaugauaauggaagac

SEQ ID NO: 8598 - RNA, 22 nt, Homo sapiens
ggcuggaugauaauggaagacu

SEQ ID NO: 8599 - RNA, 22 nt, Homo sapiens
gcuggaugauaauggaagacug

SEQ ID NO: 8600 - RNA, 22 nt, Homo sapiens
cuggaugauaauggaagacugu

SEQ ID NO: 8601 - RNA, 22 nt, Homo sapiens
uggaugauaauggaagacuguu

SEQ ID NO: 8602 - RNA, 22 nt, Homo sapiens
ggaugauaauggaagacuguuu

SEQ ID NO: 8603 - RNA, 22 nt, Homo sapiens
gaugauaauggaagacuguuug

SEQ ID NO: 8604 - RNA, 22 nt, Homo sapiens
augauaauggaagacuguuugg

SEQ ID NO: 8605 - RNA, 22 nt, Homo sapiens
ugauaauggaagacuguuuggu

SEQ ID NO: 8606 - RNA, 22 nt, Homo sapiens
gauaauggaagacuguuugguc

SEQ ID NO: 8607 - RNA, 22 nt, Homo sapiens
auaauggaagacuguuuggucu

SEQ ID NO: 8608 - RNA, 22 nt, Homo sapiens
uaauggaagacuguuuggucug

SEQ ID NO: 8609 - RNA, 22 nt, Homo sapiens
aauggaagacuguuuggucugg

SEQ ID NO: 8610 - RNA, 22 nt, Homo sapiens
auggaagacuguuuggucuggc

SEQ ID NO: 8611 - RNA, 22 nt, Homo sapiens
uggaagacuguuuggucuggcu

SEQ ID NO: 8612 - RNA, 22 nt, Homo sapiens
ggaagacuguuuggucuggcua

SEQ ID NO: 8613 - RNA, 22 nt, Homo sapiens
gaagacuguuuggucuggcuag

SEQ ID NO: 8614 - RNA, 22 nt, Homo sapiens
aagacuguuuggucuggcuaga

SEQ ID NO: 8615 - RNA, 22 nt, Homo sapiens
agacuguuuggucuggcuagag

SEQ ID NO: 8616 - RNA, 22 nt, Homo sapiens
gacuguuuggucuggcuagaga

SEQ ID NO: 8617 - RNA, 22 nt, Homo sapiens
acuguuuggucuggcuagagaa

SEQ ID NO: 8618 - RNA, 22 nt, Homo sapiens
cuguuuggucuggcuagagaag

SEQ ID NO: 8619 - RNA, 22 nt, Homo sapiens
uguuuggucuggcuagagaagc

SEQ ID NO: 8620 - RNA, 22 nt, Homo sapiens
guuuggucuggcuagagaagcu

SEQ ID NO: 8621 - RNA, 22 nt, Homo sapiens
uuuggucuggcuagagaagcug

SEQ ID NO: 8622 - RNA, 22 nt, Homo sapiens
uuggucuggcuagagaagcugg

SEQ ID NO: 8623 - RNA, 22 nt, Homo sapiens
uggucuggcuagagaagcugga

SEQ ID NO: 8624 - RNA, 22 nt, Homo sapiens
ggucuggcuagagaagcuggag

SEQ ID NO: 8625 - RNA, 22 nt, Homo sapiens
gucuggcuagagaagcuggagg

SEQ ID NO: 8626 - RNA, 22 nt, Homo sapiens
ucuggcuagagaagcuggaggu

SEQ ID NO: 8627 - RNA, 22 nt, Homo sapiens
cuggcuagagaagcuggagguu

SEQ ID NO: 8628 - RNA, 22 nt, Homo sapiens
uggcuagagaagcuggagguuu

SEQ ID NO: 8629 - RNA, 22 nt, Homo sapiens
ggcuagagaagcuggagguuuc

SEQ ID NO: 8630 - RNA, 22 nt, Homo sapiens
gcuagagaagcuggagguuucu

SEQ ID NO: 8631 - RNA, 22 nt, Homo sapiens
cuagagaagcuggagguuucug

SEQ ID NO: 8632 - RNA, 22 nt, Homo sapiens
uagagaagcuggagguuucugg

SEQ ID NO: 8633 - RNA, 22 nt, Homo sapiens
agagaagcuggagguuucuggu

SEQ ID NO: 8634 - RNA, 22 nt, Homo sapiens
gagaagcuggagguuucugguc

SEQ ID NO: 8635 - RNA, 22 nt, Homo sapiens
agaagcuggagguuucuggucc

SEQ ID NO: 8636 - RNA, 22 nt, Homo sapiens
gaagcuggagguuucuggucca

SEQ ID NO: 8637 - RNA, 22 nt, Homo sapiens
aagcuggagguuucugguccag

SEQ ID NO: 8638 - RNA, 22 nt, Homo sapiens
agcuggagguuucugguccagg

SEQ ID NO: 8639 - RNA, 22 nt, Homo sapiens
gcuggagguuucugguccagga

SEQ ID NO: 8640 - RNA, 22 nt, Homo sapiens
cuggagguuucugguccaggag

SEQ ID NO: 8641 - RNA, 22 nt, Homo sapiens
uggagguuucugguccaggagg

SEQ ID NO: 8642 - RNA, 22 nt, Homo sapiens
ggagguuucugguccaggaggc

SEQ ID NO: 8643 - RNA, 22 nt, Homo sapiens
gagguuucugguccaggaggcu

SEQ ID NO: 8644 - RNA, 22 nt, Homo sapiens
agguuucugguccaggaggcug

SEQ ID NO: 8645 - RNA, 22 nt, Homo sapiens
gguuucugguccaggaggcugc

SEQ ID NO: 8646 - RNA, 22 nt, Homo sapiens
guuucugguccaggaggcugca

SEQ ID NO: 8647 - RNA, 22 nt, Homo sapiens
uuucugguccaggaggcugcaa

SEQ ID NO: 8648 - RNA, 22 nt, Homo sapiens
uucugguccaggaggcugcaau

SEQ ID NO: 8649 - RNA, 22 nt, Homo sapiens
ucugguccaggaggcugcaauc

SEQ ID NO: 8650 - RNA, 22 nt, Homo sapiens
cugguccaggaggcugcaaucu

SEQ ID NO: 8651 - RNA, 22 nt, Homo sapiens
ugguccaggaggcugcaaucug

SEQ ID NO: 8652 - RNA, 22 nt, Homo sapiens
gguccaggaggcugcaaucugg

SEQ ID NO: 8653 - RNA, 22 nt, Homo sapiens
guccaggaggcugcaaucugga

SEQ ID NO: 8654 - RNA, 22 nt, Homo sapiens
uccaggaggcugcaaucuggag

SEQ ID NO: 8655 - RNA, 22 nt, Homo sapiens
ccaggaggcugcaaucuggagc

SEQ ID NO: 8656 - RNA, 22 nt, Homo sapiens
caggaggcugcaaucuggagcc

SEQ ID NO: 8657 - RNA, 22 nt, Homo sapiens
aggaggcugcaaucuggagcca

SEQ ID NO: 8658 - RNA, 22 nt, Homo sapiens
ggaggcugcaaucuggagccac

SEQ ID NO: 8659 - RNA, 22 nt, Homo sapiens
gaggcugcaaucuggagccaca

SEQ ID NO: 8660 - RNA, 22 nt, Homo sapiens
aggcugcaaucuggagccacau

SEQ ID NO: 8661 - RNA, 22 nt, Homo sapiens
ggcugcaaucuggagccacaug

SEQ ID NO: 8662 - RNA, 22 nt, Homo sapiens
gcugcaaucuggagccacaugg

SEQ ID NO: 8663 - RNA, 22 nt, Homo sapiens
cugcaaucuggagccacauggg

SEQ ID NO: 8664 - RNA, 22 nt, Homo sapiens
ugcaaucuggagccacaugggu

SEQ ID NO: 8665 - RNA, 22 nt, Homo sapiens
gcaaucuggagccacauggguu

SEQ ID NO: 8666 - RNA, 22 nt, Homo sapiens
caaucuggagccacauggguuu

SEQ ID NO: 8667 - RNA, 22 nt, Homo sapiens
aaucuggagccacauggguuuu

SEQ ID NO: 8668 - RNA, 22 nt, Homo sapiens
aucuggagccacauggguuuug

SEQ ID NO: 8669 - RNA, 22 nt, Homo sapiens
ucuggagccacauggguuuugg

SEQ ID NO: 8670 - RNA, 22 nt, Homo sapiens
cuggagccacauggguuuuggg

SEQ ID NO: 8671 - RNA, 22 nt, Homo sapiens
uggagccacauggguuuuggga

SEQ ID NO: 8672 - RNA, 22 nt, Homo sapiens
ggagccacauggguuuugggac

SEQ ID NO: 8673 - RNA, 22 nt, Homo sapiens
gagccacauggguuuugggacu

SEQ ID NO: 8674 - RNA, 22 nt, Homo sapiens
agccacauggguuuugggacug

SEQ ID NO: 8675 - RNA, 22 nt, Homo sapiens
gccacauggguuuugggacugg

SEQ ID NO: 8676 - RNA, 22 nt, Homo sapiens
ccacauggguuuugggacugga

SEQ ID NO: 8677 - RNA, 22 nt, Homo sapiens
cacauggguuuugggacuggau

SEQ ID NO: 8678 - RNA, 22 nt, Homo sapiens
acauggguuuugggacuggaug

SEQ ID NO: 8679 - RNA, 22 nt, Homo sapiens
cauggguuuugggacuggauga

SEQ ID NO: 8680 - RNA, 22 nt, Homo sapiens
auggguuuugggacuggaugaa

SEQ ID NO: 8681 - RNA, 22 nt, Homo sapiens
uggguuuugggacuggaugaag

SEQ ID NO: 8682 - RNA, 22 nt, Homo sapiens
ggguuuugggacuggaugaagu

SEQ ID NO: 8683 - RNA, 22 nt, Homo sapiens
gguuuugggacuggaugaagug

SEQ ID NO: 8684 - RNA, 22 nt, Homo sapiens
guuuugggacuggaugaagugu

SEQ ID NO: 8685 - RNA, 22 nt, Homo sapiens
uuuugggacuggaugaaguguu

SEQ ID NO: 8686 - RNA, 22 nt, Homo sapiens
uuugggacuggaugaaguguuu

SEQ ID NO: 8687 - RNA, 22 nt, Homo sapiens
uugggacuggaugaaguguuuu

SEQ ID NO: 8688 - RNA, 22 nt, Homo sapiens
ugggacuggaugaaguguuuug

SEQ ID NO: 8689 - RNA, 22 nt, Homo sapiens
gggacuggaugaaguguuuugg

SEQ ID NO: 8690 - RNA, 22 nt, Homo sapiens
ggacuggaugaaguguuuugga

SEQ ID NO: 8691 - RNA, 22 nt, Homo sapiens
gacuggaugaaguguuuuggac

SEQ ID NO: 8692 - RNA, 22 nt, Homo sapiens
acuggaugaaguguuuuggacg

SEQ ID NO: 8693 - RNA, 22 nt, Homo sapiens
cuggaugaaguguuuuggacgu

SEQ ID NO: 8694 - RNA, 22 nt, Homo sapiens
uggaugaaguguuuuggacguu

SEQ ID NO: 8695 - RNA, 22 nt, Homo sapiens
ggaugaaguguuuuggacguuc

SEQ ID NO: 8696 - RNA, 22 nt, Homo sapiens
gaugaaguguuuuggacguucg

SEQ ID NO: 8697 - RNA, 22 nt, Homo sapiens
augaaguguuuuggacguucgu

SEQ ID NO: 8698 - RNA, 22 nt, Homo sapiens
ugaaguguuuuggacguucgua

SEQ ID NO: 8699 - RNA, 22 nt, Homo sapiens
gaaguguuuuggacguucguag

SEQ ID NO: 8700 - RNA, 22 nt, Homo sapiens
aaguguuuuggacguucguagu

SEQ ID NO: 8701 - RNA, 22 nt, Homo sapiens
aguguuuuggacguucguaguu

SEQ ID NO: 8702 - RNA, 22 nt, Homo sapiens
guguuuuggacguucguaguua

SEQ ID NO: 8703 - RNA, 22 nt, Homo sapiens
uguuuuggacguucguaguuaa

SEQ ID NO: 8704 - RNA, 22 nt, Homo sapiens
guuuuggacguucguaguuaaa

SEQ ID NO: 8705 - RNA, 22 nt, Homo sapiens
uuuuggacguucguaguuaaac

SEQ ID NO: 8706 - RNA, 22 nt, Homo sapiens
uuuggacguucguaguuaaaca

SEQ ID NO: 8707 - RNA, 22 nt, Homo sapiens
uuggacguucguaguuaaacau

SEQ ID NO: 8708 - RNA, 22 nt, Homo sapiens
uggacguucguaguuaaacaug

SEQ ID NO: 8709 - RNA, 22 nt, Homo sapiens
ggacguucguaguuaaacaugc

SEQ ID NO: 8710 - RNA, 22 nt, Homo sapiens
gacguucguaguuaaacaugcu

SEQ ID NO: 8711 - RNA, 22 nt, Homo sapiens
acguucguaguuaaacaugcuu

SEQ ID NO: 8712 - RNA, 22 nt, Homo sapiens
cguucguaguuaaacaugcuua

SEQ ID NO: 8713 - RNA, 22 nt, Homo sapiens
guucguaguuaaacaugcuuag

SEQ ID NO: 8714 - RNA, 22 nt, Homo sapiens
uucguaguuaaacaugcuuagu

SEQ ID NO: 8715 - RNA, 22 nt, Homo sapiens
ucguaguuaaacaugcuuaguu

SEQ ID NO: 8716 - RNA, 22 nt, Homo sapiens
cguaguuaaacaugcuuaguug

SEQ ID NO: 8717 - RNA, 22 nt, Homo sapiens
guaguuaaacaugcuuaguugg

SEQ ID NO: 8718 - RNA, 22 nt, Homo sapiens
uaguuaaacaugcuuaguuggu

SEQ ID NO: 8719 - RNA, 22 nt, Homo sapiens
aguuaaacaugcuuaguuggua

SEQ ID NO: 8720 - RNA, 22 nt, Homo sapiens
guuaaacaugcuuaguugguau

SEQ ID NO: 8721 - RNA, 22 nt, Homo sapiens
uuaaacaugcuuaguugguaua

SEQ ID NO: 8722 - RNA, 22 nt, Homo sapiens
uaaacaugcuuaguugguauau

SEQ ID NO: 8723 - RNA, 22 nt, Homo sapiens
aaacaugcuuaguugguauaug

SEQ ID NO: 8724 - RNA, 22 nt, Homo sapiens
aacaugcuuaguugguauaugg

SEQ ID NO: 8725 - RNA, 22 nt, Homo sapiens
acaugcuuaguugguauaugga

SEQ ID NO: 8726 - RNA, 22 nt, Homo sapiens
caugcuuaguugguauauggaa

SEQ ID NO: 8727 - RNA, 22 nt, Homo sapiens
augcuuaguugguauauggaag

SEQ ID NO: 8728 - RNA, 22 nt, Homo sapiens
ugcuuaguugguauauggaaga

SEQ ID NO: 8729 - RNA, 22 nt, Homo sapiens
gcuuaguugguauauggaagau

SEQ ID NO: 8730 - RNA, 22 nt, Homo sapiens
cuuaguugguauauggaagaug

SEQ ID NO: 8731 - RNA, 22 nt, Homo sapiens
uuaguugguauauggaagauga

SEQ ID NO: 8732 - RNA, 22 nt, Homo sapiens
uaguugguauauggaagaugaa

SEQ ID NO: 8733 - RNA, 22 nt, Homo sapiens
aguugguauauggaagaugaag

SEQ ID NO: 8734 - RNA, 22 nt, Homo sapiens
guugguauauggaagaugaagg

SEQ ID NO: 8735 - RNA, 22 nt, Homo sapiens
uugguauauggaagaugaaggc

SEQ ID NO: 8736 - RNA, 22 nt, Homo sapiens
ugguauauggaagaugaaggca

SEQ ID NO: 8737 - RNA, 22 nt, Homo sapiens
gguauauggaagaugaaggcaa

SEQ ID NO: 8738 - RNA, 22 nt, Homo sapiens
guauauggaagaugaaggcaaa

SEQ ID NO: 8739 - RNA, 22 nt, Homo sapiens
uauauggaagaugaaggcaaau

SEQ ID NO: 8740 - RNA, 22 nt, Homo sapiens
auauggaagaugaaggcaaauu

SEQ ID NO: 8741 - RNA, 22 nt, Homo sapiens
uauggaagaugaaggcaaauua

SEQ ID NO: 8742 - RNA, 22 nt, Homo sapiens
auggaagaugaaggcaaauuau

SEQ ID NO: 8743 - RNA, 22 nt, Homo sapiens
uggaagaugaaggcaaauuauu

SEQ ID NO: 8744 - RNA, 22 nt, Homo sapiens
ggaagaugaaggcaaauuauua

SEQ ID NO: 8745 - RNA, 22 nt, Homo sapiens
gaagaugaaggcaaauuauuac

SEQ ID NO: 8746 - RNA, 22 nt, Homo sapiens
aagaugaaggcaaauuauuacu

SEQ ID NO: 8747 - RNA, 22 nt, Homo sapiens
agaugaaggcaaauuauuacua

SEQ ID NO: 8748 - RNA, 22 nt, Homo sapiens
gaugaaggcaaauuauuacuau

SEQ ID NO: 8749 - RNA, 22 nt, Homo sapiens
augaaggcaaauuauuacuaua

SEQ ID NO: 8750 - RNA, 22 nt, Homo sapiens
ugaaggcaaauuauuacuauaa

SEQ ID NO: 8751 - RNA, 22 nt, Homo sapiens
gaaggcaaauuauuacuauaau

SEQ ID NO: 8752 - RNA, 22 nt, Homo sapiens
aaggcaaauuauuacuauaaug

SEQ ID NO: 8753 - RNA, 22 nt, Homo sapiens
aggcaaauuauuacuauaauga

SEQ ID NO: 8754 - RNA, 22 nt, Homo sapiens
ggcaaauuauuacuauaaugau

SEQ ID NO: 8755 - RNA, 22 nt, Homo sapiens
gcaaauuauuacuauaaugauu

SEQ ID NO: 8756 - RNA, 22 nt, Homo sapiens
caaauuauuacuauaaugauuu

SEQ ID NO: 8757 - RNA, 22 nt, Homo sapiens
aaauuauuacuauaaugauuug

SEQ ID NO: 8758 - RNA, 22 nt, Homo sapiens
aauuauuacuauaaugauuugu

SEQ ID NO: 8759 - RNA, 22 nt, Homo sapiens
auuauuacuauaaugauuuguu

SEQ ID NO: 8760 - RNA, 22 nt, Homo sapiens
uuauuacuauaaugauuuguuc

SEQ ID NO: 8761 - RNA, 22 nt, Homo sapiens
uauuacuauaaugauuuguucc

SEQ ID NO: 8762 - RNA, 22 nt, Homo sapiens
auuacuauaaugauuuguuccu

SEQ ID NO: 8763 - RNA, 22 nt, Homo sapiens
uuacuauaaugauuuguuccug

SEQ ID NO: 8764 - RNA, 22 nt, Homo sapiens
uacuauaaugauuuguuccugg

SEQ ID NO: 8765 - RNA, 22 nt, Homo sapiens
acuauaaugauuuguuccugga

SEQ ID NO: 8766 - RNA, 22 nt, Homo sapiens
cuauaaugauuuguuccuggaa

SEQ ID NO: 8767 - RNA, 22 nt, Homo sapiens
uauaaugauuuguuccuggaag

SEQ ID NO: 8768 - RNA, 22 nt, Homo sapiens
auaaugauuuguuccuggaagg

SEQ ID NO: 8769 - RNA, 22 nt, Homo sapiens
uaaugauuuguuccuggaaggg

SEQ ID NO: 8770 - RNA, 22 nt, Homo sapiens
aaugauuuguuccuggaagggu

SEQ ID NO: 8771 - RNA, 22 nt, Homo sapiens
augauuuguuccuggaagggug

SEQ ID NO: 8772 - RNA, 22 nt, Homo sapiens
ugauuuguuccuggaagggugg

SEQ ID NO: 8773 - RNA, 22 nt, Homo sapiens
gauuuguuccuggaaggguggg

SEQ ID NO: 8774 - RNA, 22 nt, Homo sapiens
auuuguuccuggaagggugggg

SEQ ID NO: 8775 - RNA, 22 nt, Homo sapiens
uuuguuccuggaaggguggggc

SEQ ID NO: 8776 - RNA, 22 nt, Homo sapiens
uuguuccuggaaggguggggcc

SEQ ID NO: 8777 - RNA, 22 nt, Homo sapiens
uguuccuggaaggguggggccc

SEQ ID NO: 8778 - RNA, 22 nt, Homo sapiens
guuccuggaaggguggggcccu

SEQ ID NO: 8779 - RNA, 22 nt, Homo sapiens
uuccuggaaggguggggcccug

SEQ ID NO: 8780 - RNA, 22 nt, Homo sapiens
uccuggaaggguggggcccuga

SEQ ID NO: 8781 - RNA, 22 nt, Homo sapiens
ccuggaaggguggggcccugaa

SEQ ID NO: 8782 - RNA, 22 nt, Homo sapiens
cuggaaggguggggcccugaau

SEQ ID NO: 8783 - RNA, 22 nt, Homo sapiens
uggaaggguggggcccugaauu

SEQ ID NO: 8784 - RNA, 22 nt, Homo sapiens
ggaaggguggggcccugaauuu

SEQ ID NO: 8785 - RNA, 22 nt, Homo sapiens
gaaggguggggcccugaauuug

SEQ ID NO: 8786 - RNA, 22 nt, Homo sapiens
aaggguggggcccugaauuugg

SEQ ID NO: 8787 - RNA, 22 nt, Homo sapiens
aggguggggcccugaauuuggg

SEQ ID NO: 8788 - RNA, 22 nt, Homo sapiens
ggguggggcccugaauuugggg

SEQ ID NO: 8789 - RNA, 22 nt, Homo sapiens
gguggggcccugaauuuggggc

SEQ ID NO: 8790 - RNA, 22 nt, Homo sapiens
guggggcccugaauuuggggcc

SEQ ID NO: 8791 - RNA, 22 nt, Homo sapiens
uggggcccugaauuuggggcca

SEQ ID NO: 8792 - RNA, 22 nt, Homo sapiens
ggggcccugaauuuggggccac

SEQ ID NO: 8793 - RNA, 22 nt, Homo sapiens
gggcccugaauuuggggccaca

SEQ ID NO: 8794 - RNA, 22 nt, Homo sapiens
ggcccugaauuuggggccacaa

SEQ ID NO: 8795 - RNA, 22 nt, Homo sapiens
gcccugaauuuggggccacaag

SEQ ID NO: 8796 - RNA, 22 nt, Homo sapiens
cccugaauuuggggccacaagc

SEQ ID NO: 8797 - RNA, 22 nt, Homo sapiens
ccugaauuuggggccacaagcc

SEQ ID NO: 8798 - RNA, 22 nt, Homo sapiens
cugaauuuggggccacaagccu

SEQ ID NO: 8799 - RNA, 22 nt, Homo sapiens
ugaauuuggggccacaagccug

SEQ ID NO: 8800 - RNA, 22 nt, Homo sapiens
gaauuuggggccacaagccugg

SEQ ID NO: 8801 - RNA, 22 nt, Homo sapiens
aauuuggggccacaagccugga

SEQ ID NO: 8802 - RNA, 22 nt, Homo sapiens
auuuggggccacaagccuggaa

SEQ ID NO: 8803 - RNA, 22 nt, Homo sapiens
uuuggggccacaagccuggaau

SEQ ID NO: 8804 - RNA, 22 nt, Homo sapiens
uuggggccacaagccuggaauu

SEQ ID NO: 8805 - RNA, 22 nt, Homo sapiens
uggggccacaagccuggaauua

SEQ ID NO: 8806 - RNA, 22 nt, Homo sapiens
ggggccacaagccuggaauuac

SEQ ID NO: 8807 - RNA, 22 nt, Homo sapiens
gggccacaagccuggaauuacg

SEQ ID NO: 8808 - RNA, 22 nt, Homo sapiens
ggccacaagccuggaauuacgg

SEQ ID NO: 8809 - RNA, 22 nt, Homo sapiens
gccacaagccuggaauuacgga

SEQ ID NO: 8810 - RNA, 22 nt, Homo sapiens
ccacaagccuggaauuacggaa

SEQ ID NO: 8811 - RNA, 22 nt, Homo sapiens
cacaagccuggaauuacggaag

SEQ ID NO: 8812 - RNA, 22 nt, Homo sapiens
acaagccuggaauuacggaagg

SEQ ID NO: 8813 - RNA, 22 nt, Homo sapiens
caagccuggaauuacggaaggu

SEQ ID NO: 8814 - RNA, 22 nt, Homo sapiens
aagccuggaauuacggaagguu

SEQ ID NO: 8815 - RNA, 22 nt, Homo sapiens
agccuggaauuacggaagguug

SEQ ID NO: 8816 - RNA, 22 nt, Homo sapiens
gccuggaauuacggaagguugu

SEQ ID NO: 8817 - RNA, 22 nt, Homo sapiens
ccuggaauuacggaagguugua

SEQ ID NO: 8818 - RNA, 22 nt, Homo sapiens
cuggaauuacggaagguuguaa

SEQ ID NO: 8819 - RNA, 22 nt, Homo sapiens
uggaauuacggaagguuguaag

SEQ ID NO: 8820 - RNA, 22 nt, Homo sapiens
ggaauuacggaagguuguaagg

SEQ ID NO: 8821 - RNA, 22 nt, Homo sapiens
gaauuacggaagguuguaagga

SEQ ID NO: 8822 - RNA, 22 nt, Homo sapiens
aauuacggaagguuguaaggaa

SEQ ID NO: 8823 - RNA, 22 nt, Homo sapiens
auuacggaagguuguaaggaau

SEQ ID NO: 8824 - RNA, 22 nt, Homo sapiens
uuacggaagguuguaaggaauc

SEQ ID NO: 8825 - RNA, 22 nt, Homo sapiens
uacggaagguuguaaggaauca

SEQ ID NO: 8826 - RNA, 22 nt, Homo sapiens
acggaagguuguaaggaaucag

SEQ ID NO: 8827 - RNA, 22 nt, Homo sapiens
cggaagguuguaaggaaucaga

SEQ ID NO: 8828 - RNA, 22 nt, Homo sapiens
ggaagguuguaaggaaucagaa

SEQ ID NO: 8829 - RNA, 22 nt, Homo sapiens
gaagguuguaaggaaucagaag

SEQ ID NO: 8830 - RNA, 22 nt, Homo sapiens
aagguuguaaggaaucagaagc

SEQ ID NO: 8831 - RNA, 22 nt, Homo sapiens
agguuguaaggaaucagaagca

SEQ ID NO: 8832 - RNA, 22 nt, Homo sapiens
gguuguaaggaaucagaagcaa

SEQ ID NO: 8833 - RNA, 22 nt, Homo sapiens
guuguaaggaaucagaagcaac

SEQ ID NO: 8834 - RNA, 22 nt, Homo sapiens
uuguaaggaaucagaagcaacc

SEQ ID NO: 8835 - RNA, 22 nt, Homo sapiens
uguaaggaaucagaagcaaccu

SEQ ID NO: 8836 - RNA, 22 nt, Homo sapiens
guaaggaaucagaagcaaccuu

SEQ ID NO: 8837 - RNA, 22 nt, Homo sapiens
uaaggaaucagaagcaaccuug

SEQ ID NO: 8838 - RNA, 22 nt, Homo sapiens
aaggaaucagaagcaaccuugg

SEQ ID NO: 8839 - RNA, 22 nt, Homo sapiens
aggaaucagaagcaaccuuggu

SEQ ID NO: 8840 - RNA, 22 nt, Homo sapiens
ggaaucagaagcaaccuugguc

SEQ ID NO: 8841 - RNA, 22 nt, Homo sapiens
gaaucagaagcaaccuuggucu

SEQ ID NO: 8842 - RNA, 22 nt, Homo sapiens
aaucagaagcaaccuuggucug

SEQ ID NO: 8843 - RNA, 22 nt, Homo sapiens
aucagaagcaaccuuggucugc

SEQ ID NO: 8844 - RNA, 22 nt, Homo sapiens
ucagaagcaaccuuggucugcu

SEQ ID NO: 8845 - RNA, 22 nt, Homo sapiens
cagaagcaaccuuggucugcuc

SEQ ID NO: 8846 - RNA, 22 nt, Homo sapiens
agaagcaaccuuggucugcucu

SEQ ID NO: 8847 - RNA, 22 nt, Homo sapiens
gaagcaaccuuggucugcucuu

SEQ ID NO: 8848 - RNA, 22 nt, Homo sapiens
aagcaaccuuggucugcucuuc

SEQ ID NO: 8849 - RNA, 22 nt, Homo sapiens
agcaaccuuggucugcucuucc

SEQ ID NO: 8850 - RNA, 22 nt, Homo sapiens
gcaaccuuggucugcucuuccu

SEQ ID NO: 8851 - RNA, 22 nt, Homo sapiens
caaccuuggucugcucuuccuu

SEQ ID NO: 8852 - RNA, 22 nt, Homo sapiens
aaccuuggucugcucuuccuug

SEQ ID NO: 8853 - RNA, 22 nt, Homo sapiens
accuuggucugcucuuccuugu

SEQ ID NO: 8854 - RNA, 22 nt, Homo sapiens
ccuuggucugcucuuccuuguu

SEQ ID NO: 8855 - RNA, 22 nt, Homo sapiens
cuuggucugcucuuccuuguug

SEQ ID NO: 8856 - RNA, 22 nt, Homo sapiens
uuggucugcucuuccuuguuga

SEQ ID NO: 8857 - RNA, 22 nt, Homo sapiens
uggucugcucuuccuuguugag

SEQ ID NO: 8858 - RNA, 22 nt, Homo sapiens
ggucugcucuuccuuguugaga

SEQ ID NO: 8859 - RNA, 22 nt, Homo sapiens
gucugcucuuccuuguugagau

SEQ ID NO: 8860 - RNA, 22 nt, Homo sapiens
ucugcucuuccuuguugagauc

SEQ ID NO: 8861 - RNA, 22 nt, Homo sapiens
cugcucuuccuuguugagaucc

SEQ ID NO: 8862 - RNA, 22 nt, Homo sapiens
ugcucuuccuuguugagauccu

SEQ ID NO: 8863 - RNA, 22 nt, Homo sapiens
gcucuuccuuguugagauccug

SEQ ID NO: 8864 - RNA, 22 nt, Homo sapiens
cucuuccuuguugagauccuga

SEQ ID NO: 8865 - RNA, 22 nt, Homo sapiens
ucuuccuuguugagauccugag

SEQ ID NO: 8866 - RNA, 22 nt, Homo sapiens
cuuccuuguugagauccugaga

SEQ ID NO: 8867 - RNA, 22 nt, Homo sapiens
uuccuuguugagauccugagaa

SEQ ID NO: 8868 - RNA, 22 nt, Homo sapiens
uccuuguugagauccugagaau

SEQ ID NO: 8869 - RNA, 22 nt, Homo sapiens
ccuuguugagauccugagaaua

SEQ ID NO: 8870 - RNA, 22 nt, Homo sapiens
cuuguugagauccugagaauac

SEQ ID NO: 8871 - RNA, 22 nt, Homo sapiens
uuguugagauccugagaauacu

SEQ ID NO: 8872 - RNA, 22 nt, Homo sapiens
uguugagauccugagaauacug

SEQ ID NO: 8873 - RNA, 22 nt, Homo sapiens
guugagauccugagaauacugu

SEQ ID NO: 8874 - RNA, 22 nt, Homo sapiens
uugagauccugagaauacugug

SEQ ID NO: 8875 - RNA, 22 nt, Homo sapiens
ugagauccugagaauacugugc

SEQ ID NO: 8876 - RNA, 22 nt, Homo sapiens
gagauccugagaauacugugcu

SEQ ID NO: 8877 - RNA, 22 nt, Homo sapiens
agauccugagaauacugugcuc

SEQ ID NO: 8878 - RNA, 22 nt, Homo sapiens
gauccugagaauacugugcucc

SEQ ID NO: 8879 - RNA, 22 nt, Homo sapiens
auccugagaauacugugcuccu

SEQ ID NO: 8880 - RNA, 22 nt, Homo sapiens
uccugagaauacugugcuccug

SEQ ID NO: 8881 - RNA, 22 nt, Homo sapiens
ccugagaauacugugcuccugg

SEQ ID NO: 8882 - RNA, 22 nt, Homo sapiens
cugagaauacugugcuccuggc

SEQ ID NO: 8883 - RNA, 22 nt, Homo sapiens
ugagaauacugugcuccuggcu

SEQ ID NO: 8884 - RNA, 22 nt, Homo sapiens
gagaauacugugcuccuggcuu

SEQ ID NO: 8885 - RNA, 22 nt, Homo sapiens
agaauacugugcuccuggcuuu

SEQ ID NO: 8886 - RNA, 22 nt, Homo sapiens
gaauacugugcuccuggcuuug

SEQ ID NO: 8887 - RNA, 22 nt, Homo sapiens
aauacugugcuccuggcuuugg

SEQ ID NO: 8888 - RNA, 22 nt, Homo sapiens
auacugugcuccuggcuuuggu

SEQ ID NO: 8889 - RNA, 22 nt, Homo sapiens
uacugugcuccuggcuuuggua

SEQ ID NO: 8890 - RNA, 22 nt, Homo sapiens
acugugcuccuggcuuugguag

SEQ ID NO: 8891 - RNA, 22 nt, Homo sapiens
cugugcuccuggcuuugguaga

SEQ ID NO: 8892 - RNA, 22 nt, Homo sapiens
ugugcuccuggcuuugguagag

SEQ ID NO: 8893 - RNA, 22 nt, Homo sapiens
gugcuccuggcuuugguagagu

SEQ ID NO: 8894 - RNA, 22 nt, Homo sapiens
ugcuccuggcuuugguagagug

SEQ ID NO: 8895 - RNA, 22 nt, Homo sapiens
gcuccuggcuuugguagaguga

SEQ ID NO: 8896 - RNA, 22 nt, Homo sapiens
cuccuggcuuugguagagugac

SEQ ID NO: 8897 - RNA, 22 nt, Homo sapiens
uccuggcuuugguagagugacc

SEQ ID NO: 8898 - RNA, 22 nt, Homo sapiens
ccuggcuuugguagagugaccu

SEQ ID NO: 8899 - RNA, 22 nt, Homo sapiens
cuggcuuugguagagugaccuu

SEQ ID NO: 8900 - RNA, 22 nt, Homo sapiens
uggcuuugguagagugaccuuc

SEQ ID NO: 8901 - RNA, 22 nt, Homo sapiens
ggcuuugguagagugaccuucu

SEQ ID NO: 8902 - RNA, 22 nt, Homo sapiens
gcuuugguagagugaccuucuc

SEQ ID NO: 8903 - RNA, 22 nt, Homo sapiens
cuuugguagagugaccuucucu

SEQ ID NO: 8904 - RNA, 22 nt, Homo sapiens
uuugguagagugaccuucucuu

SEQ ID NO: 8905 - RNA, 22 nt, Homo sapiens
uugguagagugaccuucucuug

SEQ ID NO: 8906 - RNA, 22 nt, Homo sapiens
ugguagagugaccuucucuuga

SEQ ID NO: 8907 - RNA, 22 nt, Homo sapiens
gguagagugaccuucucuugaa

SEQ ID NO: 8908 - RNA, 22 nt, Homo sapiens
guagagugaccuucucuugaag

SEQ ID NO: 8909 - RNA, 22 nt, Homo sapiens
uagagugaccuucucuugaaga

SEQ ID NO: 8910 - RNA, 22 nt, Homo sapiens
agagugaccuucucuugaagaa

SEQ ID NO: 8911 - RNA, 22 nt, Homo sapiens
gagugaccuucucuugaagaau

SEQ ID NO: 8912 - RNA, 22 nt, Homo sapiens
agugaccuucucuugaagaaua

SEQ ID NO: 8913 - RNA, 22 nt, Homo sapiens
gugaccuucucuugaagaauau

SEQ ID NO: 8914 - RNA, 22 nt, Homo sapiens
ugaccuucucuugaagaauauu

SEQ ID NO: 8915 - RNA, 22 nt, Homo sapiens
gaccuucucuugaagaauauug

SEQ ID NO: 8916 - RNA, 22 nt, Homo sapiens
accuucucuugaagaauauugu

SEQ ID NO: 8917 - RNA, 22 nt, Homo sapiens
ccuucucuugaagaauauuguu

SEQ ID NO: 8918 - RNA, 22 nt, Homo sapiens
cuucucuugaagaauauuguuc

SEQ ID NO: 8919 - RNA, 22 nt, Homo sapiens
uucucuugaagaauauuguucc

SEQ ID NO: 8920 - RNA, 22 nt, Homo sapiens
ucucuugaagaauauuguuccc

SEQ ID NO: 8921 - RNA, 22 nt, Homo sapiens
cucuugaagaauauuguucccg

SEQ ID NO: 8922 - RNA, 22 nt, Homo sapiens
ucuugaagaauauuguucccgu

SEQ ID NO: 8923 - RNA, 22 nt, Homo sapiens
cuugaagaauauuguucccgua

SEQ ID NO: 8924 - RNA, 22 nt, Homo sapiens
uugaagaauauuguucccguag

SEQ ID NO: 8925 - RNA, 22 nt, Homo sapiens
ugaagaauauuguucccguagu

SEQ ID NO: 8926 - RNA, 22 nt, Homo sapiens
gaagaauauuguucccguaguu

SEQ ID NO: 8927 - RNA, 22 nt, Homo sapiens
aagaauauuguucccguaguuc

SEQ ID NO: 8928 - RNA, 22 nt, Homo sapiens
agaauauuguucccguaguucc

SEQ ID NO: 8929 - RNA, 22 nt, Homo sapiens
gaauauuguucccguaguucca

SEQ ID NO: 8930 - RNA, 22 nt, Homo sapiens
aauauuguucccguaguuccag

SEQ ID NO: 8931 - RNA, 22 nt, Homo sapiens
auauuguucccguaguuccaga

SEQ ID NO: 8932 - RNA, 22 nt, Homo sapiens
uauuguucccguaguuccagag

SEQ ID NO: 8933 - RNA, 22 nt, Homo sapiens
auuguucccguaguuccagagg

SEQ ID NO: 8934 - RNA, 22 nt, Homo sapiens
uuguucccguaguuccagaggg

SEQ ID NO: 8935 - RNA, 22 nt, Homo sapiens
uguucccguaguuccagagggu

SEQ ID NO: 8936 - RNA, 22 nt, Homo sapiens
guucccguaguuccagagggug

SEQ ID NO: 8937 - RNA, 22 nt, Homo sapiens
uucccguaguuccagagggugc

SEQ ID NO: 8938 - RNA, 22 nt, Homo sapiens
ucccguaguuccagagggugcc

SEQ ID NO: 8939 - RNA, 22 nt, Homo sapiens
cccguaguuccagagggugcca

SEQ ID NO: 8940 - RNA, 22 nt, Homo sapiens
ccguaguuccagagggugccag

SEQ ID NO: 8941 - RNA, 22 nt, Homo sapiens
cguaguuccagagggugccagc

SEQ ID NO: 8942 - RNA, 22 nt, Homo sapiens
guaguuccagagggugccagcu

SEQ ID NO: 8943 - RNA, 22 nt, Homo sapiens
uaguuccagagggugccagcug

SEQ ID NO: 8944 - RNA, 22 nt, Homo sapiens
aguuccagagggugccagcugg

SEQ ID NO: 8945 - RNA, 22 nt, Homo sapiens
guuccagagggugccagcuggg

SEQ ID NO: 8946 - RNA, 22 nt, Homo sapiens
uuccagagggugccagcugggu

SEQ ID NO: 8947 - RNA, 22 nt, Homo sapiens
uccagagggugccagcuggguu

SEQ ID NO: 8948 - RNA, 22 nt, Homo sapiens
ccagagggugccagcuggguuu

SEQ ID NO: 8949 - RNA, 22 nt, Homo sapiens
cagagggugccagcuggguuua

SEQ ID NO: 8950 - RNA, 22 nt, Homo sapiens
agagggugccagcuggguuuaa

SEQ ID NO: 8951 - RNA, 22 nt, Homo sapiens
gagggugccagcuggguuuaac

SEQ ID NO: 8952 - RNA, 22 nt, Homo sapiens
agggugccagcuggguuuaacc

SEQ ID NO: 8953 - RNA, 22 nt, Homo sapiens
gggugccagcuggguuuaaccc

SEQ ID NO: 8954 - RNA, 22 nt, Homo sapiens
ggugccagcuggguuuaaccca

SEQ ID NO: 8955 - RNA, 22 nt, Homo sapiens
gugccagcuggguuuaacccac

SEQ ID NO: 8956 - RNA, 22 nt, Homo sapiens
ugccagcuggguuuaacccacu

SEQ ID NO: 8957 - RNA, 22 nt, Homo sapiens
gccagcuggguuuaacccacua

SEQ ID NO: 8958 - RNA, 22 nt, Homo sapiens
ccagcuggguuuaacccacuau

SEQ ID NO: 8959 - RNA, 22 nt, Homo sapiens
cagcuggguuuaacccacuauu

SEQ ID NO: 8960 - RNA, 22 nt, Homo sapiens
agcuggguuuaacccacuauug

SEQ ID NO: 8961 - RNA, 22 nt, Homo sapiens
gcuggguuuaacccacuauuga

SEQ ID NO: 8962 - RNA, 22 nt, Homo sapiens
cuggguuuaacccacuauugaa

SEQ ID NO: 8963 - RNA, 22 nt, Homo sapiens
uggguuuaacccacuauugaag

SEQ ID NO: 8964 - RNA, 22 nt, Homo sapiens
ggguuuaacccacuauugaagg

SEQ ID NO: 8965 - RNA, 22 nt, Homo sapiens
gguuuaacccacuauugaaggg

SEQ ID NO: 8966 - RNA, 22 nt, Homo sapiens
guuuaacccacuauugaaggga

SEQ ID NO: 8967 - RNA, 22 nt, Homo sapiens
uuuaacccacuauugaagggaa

SEQ ID NO: 8968 - RNA, 22 nt, Homo sapiens
uuaacccacuauugaagggaag

SEQ ID NO: 8969 - RNA, 22 nt, Homo sapiens
uaacccacuauugaagggaagg

SEQ ID NO: 8970 - RNA, 22 nt, Homo sapiens
aacccacuauugaagggaagga

SEQ ID NO: 8971 - RNA, 22 nt, Homo sapiens
acccacuauugaagggaaggaa

SEQ ID NO: 8972 - RNA, 22 nt, Homo sapiens
cccacuauugaagggaaggaag

SEQ ID NO: 8973 - RNA, 22 nt, Homo sapiens
ccacuauugaagggaaggaaga

SEQ ID NO: 8974 - RNA, 22 nt, Homo sapiens
cacuauugaagggaaggaagag

SEQ ID NO: 8975 - RNA, 22 nt, Homo sapiens
acuauugaagggaaggaagagg

SEQ ID NO: 8976 - RNA, 22 nt, Homo sapiens
cuauugaagggaaggaagaggc

SEQ ID NO: 8977 - RNA, 22 nt, Homo sapiens
uauugaagggaaggaagaggca

SEQ ID NO: 8978 - RNA, 22 nt, Homo sapiens
auugaagggaaggaagaggcau

SEQ ID NO: 8979 - RNA, 22 nt, Homo sapiens
uugaagggaaggaagaggcauc

SEQ ID NO: 8980 - RNA, 22 nt, Homo sapiens
ugaagggaaggaagaggcaucu

SEQ ID NO: 8981 - RNA, 22 nt, Homo sapiens
gaagggaaggaagaggcaucuc

SEQ ID NO: 8982 - RNA, 22 nt, Homo sapiens
aagggaaggaagaggcaucucc

SEQ ID NO: 8983 - RNA, 22 nt, Homo sapiens
agggaaggaagaggcaucuccu

SEQ ID NO: 8984 - RNA, 22 nt, Homo sapiens
gggaaggaagaggcaucuccuu

SEQ ID NO: 8985 - RNA, 22 nt, Homo sapiens
ggaaggaagaggcaucuccuuc

SEQ ID NO: 8986 - RNA, 22 nt, Homo sapiens
gaaggaagaggcaucuccuucc

SEQ ID NO: 8987 - RNA, 22 nt, Homo sapiens
aaggaagaggcaucuccuuccc

SEQ ID NO: 8988 - RNA, 22 nt, Homo sapiens
aggaagaggcaucuccuucccu

SEQ ID NO: 8989 - RNA, 22 nt, Homo sapiens
ggaagaggcaucuccuucccuc

SEQ ID NO: 8990 - RNA, 22 nt, Homo sapiens
gaagaggcaucuccuucccuca

SEQ ID NO: 8991 - RNA, 22 nt, Homo sapiens
aagaggcaucuccuucccucac

SEQ ID NO: 8992 - RNA, 22 nt, Homo sapiens
agaggcaucuccuucccucaca

SEQ ID NO: 8993 - RNA, 22 nt, Homo sapiens
gaggcaucuccuucccucacag

SEQ ID NO: 8994 - RNA, 22 nt, Homo sapiens
aggcaucuccuucccucacaga

SEQ ID NO: 8995 - RNA, 22 nt, Homo sapiens
ggcaucuccuucccucacagac

SEQ ID NO: 8996 - RNA, 22 nt, Homo sapiens
gcaucuccuucccucacagacu

SEQ ID NO: 8997 - RNA, 22 nt, Homo sapiens
caucuccuucccucacagacua

SEQ ID NO: 8998 - RNA, 22 nt, Homo sapiens
aucuccuucccucacagacuaa

SEQ ID NO: 8999 - RNA, 22 nt, Homo sapiens
ucuccuucccucacagacuaau

SEQ ID NO: 9000 - RNA, 22 nt, Homo sapiens
cuccuucccucacagacuaauc

SEQ ID NO: 9001 - RNA, 22 nt, Homo sapiens
uccuucccucacagacuaaucu

SEQ ID NO: 9002 - RNA, 22 nt, Homo sapiens
ccuucccucacagacuaaucua

SEQ ID NO: 9003 - RNA, 22 nt, Homo sapiens
cuucccucacagacuaaucuag

SEQ ID NO: 9004 - RNA, 22 nt, Homo sapiens
uucccucacagacuaaucuagu

SEQ ID NO: 9005 - RNA, 22 nt, Homo sapiens
ucccucacagacuaaucuagug

SEQ ID NO: 9006 - RNA, 22 nt, Homo sapiens
cccucacagacuaaucuagugg

SEQ ID NO: 9007 - RNA, 22 nt, Homo sapiens
ccucacagacuaaucuaguggc

SEQ ID NO: 9008 - RNA, 22 nt, Homo sapiens
cucacagacuaaucuaguggcu

SEQ ID NO: 9009 - RNA, 22 nt, Homo sapiens
ucacagacuaaucuaguggcuc

SEQ ID NO: 9010 - RNA, 22 nt, Homo sapiens
cacagacuaaucuaguggcucu

SEQ ID NO: 9011 - RNA, 22 nt, Homo sapiens
acagacuaaucuaguggcucug

SEQ ID NO: 9012 - RNA, 22 nt, Homo sapiens
cagacuaaucuaguggcucugu

SEQ ID NO: 9013 - RNA, 22 nt, Homo sapiens
agacuaaucuaguggcucugug

SEQ ID NO: 9014 - RNA, 22 nt, Homo sapiens
gacuaaucuaguggcucugugc

SEQ ID NO: 9015 - RNA, 22 nt, Homo sapiens
acuaaucuaguggcucugugcu

SEQ ID NO: 9016 - RNA, 22 nt, Homo sapiens
cuaaucuaguggcucugugcuu

SEQ ID NO: 9017 - RNA, 23 nt, Homo sapiens
uccguuuuaaauauuugaauuuu

SEQ ID NO: 9018 - RNA, 23 nt, Homo sapiens
ccguuuuaaauauuugaauuuua

SEQ ID NO: 9019 - RNA, 23 nt, Homo sapiens
cguuuuaaauauuugaauuuuau

SEQ ID NO: 9020 - RNA, 23 nt, Homo sapiens
guuuuaaauauuugaauuuuauu

SEQ ID NO: 9021 - RNA, 23 nt, Homo sapiens
uuuuaaauauuugaauuuuauuu

SEQ ID NO: 9022 - RNA, 23 nt, Homo sapiens
uuuaaauauuugaauuuuauuuu

SEQ ID NO: 9023 - RNA, 23 nt, Homo sapiens
uuaaauauuugaauuuuauuuuc

SEQ ID NO: 9024 - RNA, 23 nt, Homo sapiens
uaaauauuugaauuuuauuuucu

SEQ ID NO: 9025 - RNA, 23 nt, Homo sapiens
aaauauuugaauuuuauuuucuu

SEQ ID NO: 9026 - RNA, 23 nt, Homo sapiens
aauauuugaauuuuauuuucuuu

SEQ ID NO: 9027 - RNA, 23 nt, Homo sapiens
auauuugaauuuuauuuucuuuu

SEQ ID NO: 9028 - RNA, 23 nt, Homo sapiens
uauuugaauuuuauuuucuuuug

SEQ ID NO: 9029 - RNA, 23 nt, Homo sapiens
auuugaauuuuauuuucuuuuga

SEQ ID NO: 9030 - RNA, 23 nt, Homo sapiens
uuugaauuuuauuuucuuuugac

SEQ ID NO: 9031 - RNA, 23 nt, Homo sapiens
uugaauuuuauuuucuuuugaca

SEQ ID NO: 9032 - RNA, 23 nt, Homo sapiens
ugaauuuuauuuucuuuugacau

SEQ ID NO: 9033 - RNA, 23 nt, Homo sapiens
gaauuuuauuuucuuuugacaua

SEQ ID NO: 9034 - RNA, 23 nt, Homo sapiens
aauuuuauuuucuuuugacauac

SEQ ID NO: 9035 - RNA, 23 nt, Homo sapiens
auuuuauuuucuuuugacauaca

SEQ ID NO: 9036 - RNA, 23 nt, Homo sapiens
uuuuauuuucuuuugacauacaa

SEQ ID NO: 9037 - RNA, 23 nt, Homo sapiens
uuuauuuucuuuugacauacaac

SEQ ID NO: 9038 - RNA, 23 nt, Homo sapiens
uuauuuucuuuugacauacaacu

SEQ ID NO: 9039 - RNA, 23 nt, Homo sapiens
uauuuucuuuugacauacaacug

SEQ ID NO: 9040 - RNA, 23 nt, Homo sapiens
auuuucuuuugacauacaacugu

SEQ ID NO: 9041 - RNA, 23 nt, Homo sapiens
uuuucuuuugacauacaacugug

SEQ ID NO: 9042 - RNA, 23 nt, Homo sapiens
uuucuuuugacauacaacugugg

SEQ ID NO: 9043 - RNA, 23 nt, Homo sapiens
uucuuuugacauacaacugugga

SEQ ID NO: 9044 - RNA, 23 nt, Homo sapiens
ucuuuugacauacaacuguggaa

SEQ ID NO: 9045 - RNA, 23 nt, Homo sapiens
cuuuugacauacaacuguggaac

SEQ ID NO: 9046 - RNA, 23 nt, Homo sapiens
uuuugacauacaacuguggaaca

SEQ ID NO: 9047 - RNA, 23 nt, Homo sapiens
uuugacauacaacuguggaacac

SEQ ID NO: 9048 - RNA, 23 nt, Homo sapiens
uugacauacaacuguggaacacu

SEQ ID NO: 9049 - RNA, 23 nt, Homo sapiens
ugacauacaacuguggaacacuc

SEQ ID NO: 9050 - RNA, 23 nt, Homo sapiens
gacauacaacuguggaacacuca

SEQ ID NO: 9051 - RNA, 23 nt, Homo sapiens
acauacaacuguggaacacucag

SEQ ID NO: 9052 - RNA, 23 nt, Homo sapiens
cauacaacuguggaacacucaga

SEQ ID NO: 9053 - RNA, 23 nt, Homo sapiens
auacaacuguggaacacucagau

SEQ ID NO: 9054 - RNA, 23 nt, Homo sapiens
uacaacuguggaacacucagaua

SEQ ID NO: 9055 - RNA, 23 nt, Homo sapiens
acaacuguggaacacucagauaa

SEQ ID NO: 9056 - RNA, 23 nt, Homo sapiens
caacuguggaacacucagauaau

SEQ ID NO: 9057 - RNA, 23 nt, Homo sapiens
aacuguggaacacucagauaauc

SEQ ID NO: 9058 - RNA, 23 nt, Homo sapiens
acuguggaacacucagauaaucu

SEQ ID NO: 9059 - RNA, 23 nt, Homo sapiens
cuguggaacacucagauaaucua

SEQ ID NO: 9060 - RNA, 23 nt, Homo sapiens
uguggaacacucagauaaucuau

SEQ ID NO: 9061 - RNA, 23 nt, Homo sapiens
guggaacacucagauaaucuaua

SEQ ID NO: 9062 - RNA, 23 nt, Homo sapiens
uggaacacucagauaaucuauac

SEQ ID NO: 9063 - RNA, 23 nt, Homo sapiens
ggaacacucagauaaucuauacc

SEQ ID NO: 9064 - RNA, 23 nt, Homo sapiens
gaacacucagauaaucuauacca

SEQ ID NO: 9065 - RNA, 23 nt, Homo sapiens
aacacucagauaaucuauaccau

SEQ ID NO: 9066 - RNA, 23 nt, Homo sapiens
acacucagauaaucuauaccaug

SEQ ID NO: 9067 - RNA, 23 nt, Homo sapiens
cacucagauaaucuauaccaugu

SEQ ID NO: 9068 - RNA, 23 nt, Homo sapiens
acucagauaaucuauaccauguu

SEQ ID NO: 9069 - RNA, 23 nt, Homo sapiens
cucagauaaucuauaccauguua

SEQ ID NO: 9070 - RNA, 23 nt, Homo sapiens
ucagauaaucuauaccauguuag

SEQ ID NO: 9071 - RNA, 23 nt, Homo sapiens
cagauaaucuauaccauguuagu

SEQ ID NO: 9072 - RNA, 23 nt, Homo sapiens
agauaaucuauaccauguuagua

SEQ ID NO: 9073 - RNA, 23 nt, Homo sapiens
gauaaucuauaccauguuaguau

SEQ ID NO: 9074 - RNA, 23 nt, Homo sapiens
auaaucuauaccauguuaguauu

SEQ ID NO: 9075 - RNA, 23 nt, Homo sapiens
uaaucuauaccauguuaguauuc

SEQ ID NO: 9076 - RNA, 23 nt, Homo sapiens
aaucuauaccauguuaguauucc

SEQ ID NO: 9077 - RNA, 23 nt, Homo sapiens
aucuauaccauguuaguauuccu

SEQ ID NO: 9078 - RNA, 23 nt, Homo sapiens
ucuauaccauguuaguauuccua

SEQ ID NO: 9079 - RNA, 23 nt, Homo sapiens
cuauaccauguuaguauuccuac

SEQ ID NO: 9080 - RNA, 23 nt, Homo sapiens
uauaccauguuaguauuccuaca

SEQ ID NO: 9081 - RNA, 23 nt, Homo sapiens
auaccauguuaguauuccuacaa

SEQ ID NO: 9082 - RNA, 23 nt, Homo sapiens
uaccauguuaguauuccuacaag

SEQ ID NO: 9083 - RNA, 23 nt, Homo sapiens
accauguuaguauuccuacaaga

SEQ ID NO: 9084 - RNA, 23 nt, Homo sapiens
ccauguuaguauuccuacaagag

SEQ ID NO: 9085 - RNA, 23 nt, Homo sapiens
cauguuaguauuccuacaagaga

SEQ ID NO: 9086 - RNA, 23 nt, Homo sapiens
auguuaguauuccuacaagagaa

SEQ ID NO: 9087 - RNA, 23 nt, Homo sapiens
uguuaguauuccuacaagagaaa

SEQ ID NO: 9088 - RNA, 23 nt, Homo sapiens
guuaguauuccuacaagagaaaa

SEQ ID NO: 9089 - RNA, 23 nt, Homo sapiens
uuaguauuccuacaagagaaaac

SEQ ID NO: 9090 - RNA, 23 nt, Homo sapiens
uaguauuccuacaagagaaaacg

SEQ ID NO: 9091 - RNA, 23 nt, Homo sapiens
aguauuccuacaagagaaaacgg

SEQ ID NO: 9092 - RNA, 23 nt, Homo sapiens
guauuccuacaagagaaaacggg

SEQ ID NO: 9093 - RNA, 23 nt, Homo sapiens
uauuccuacaagagaaaacgggu

SEQ ID NO: 9094 - RNA, 23 nt, Homo sapiens
auuccuacaagagaaaacgggua

SEQ ID NO: 9095 - RNA, 23 nt, Homo sapiens
uuccuacaagagaaaacggguaa

SEQ ID NO: 9096 - RNA, 23 nt, Homo sapiens
uccuacaagagaaaacggguaaa

SEQ ID NO: 9097 - RNA, 23 nt, Homo sapiens
ccuacaagagaaaacggguaaaa

SEQ ID NO: 9098 - RNA, 23 nt, Homo sapiens
cuacaagagaaaacggguaaaac

SEQ ID NO: 9099 - RNA, 23 nt, Homo sapiens
uacaagagaaaacggguaaaaca

SEQ ID NO: 9100 - RNA, 23 nt, Homo sapiens
acaagagaaaacggguaaaacag

SEQ ID NO: 9101 - RNA, 23 nt, Homo sapiens
caagagaaaacggguaaaacagu

SEQ ID NO: 9102 - RNA, 23 nt, Homo sapiens
aagagaaaacggguaaaacagua

SEQ ID NO: 9103 - RNA, 23 nt, Homo sapiens
agagaaaacggguaaaacaguau

SEQ ID NO: 9104 - RNA, 23 nt, Homo sapiens
gagaaaacggguaaaacaguauu

SEQ ID NO: 9105 - RNA, 23 nt, Homo sapiens
agaaaacggguaaaacaguauuu

SEQ ID NO: 9106 - RNA, 23 nt, Homo sapiens
gaaaacggguaaaacaguauuua

SEQ ID NO: 9107 - RNA, 23 nt, Homo sapiens
aaaacggguaaaacaguauuuag

SEQ ID NO: 9108 - RNA, 23 nt, Homo sapiens
aaacggguaaaacaguauuuaga

SEQ ID NO: 9109 - RNA, 23 nt, Homo sapiens
aacggguaaaacaguauuuagaa

SEQ ID NO: 9110 - RNA, 23 nt, Homo sapiens
acggguaaaacaguauuuagaaa

SEQ ID NO: 9111 - RNA, 23 nt, Homo sapiens
cggguaaaacaguauuuagaaag

SEQ ID NO: 9112 - RNA, 23 nt, Homo sapiens
ggguaaaacaguauuuagaaagc

SEQ ID NO: 9113 - RNA, 23 nt, Homo sapiens
gguaaaacaguauuuagaaagca

SEQ ID NO: 9114 - RNA, 23 nt, Homo sapiens
guaaaacaguauuuagaaagcag

SEQ ID NO: 9115 - RNA, 23 nt, Homo sapiens
uaaaacaguauuuagaaagcagu

SEQ ID NO: 9116 - RNA, 23 nt, Homo sapiens
aaaacaguauuuagaaagcagua

SEQ ID NO: 9117 - RNA, 23 nt, Homo sapiens
aaacaguauuuagaaagcaguac

SEQ ID NO: 9118 - RNA, 23 nt, Homo sapiens
aacaguauuuagaaagcaguacc

SEQ ID NO: 9119 - RNA, 23 nt, Homo sapiens
acaguauuuagaaagcaguacca

SEQ ID NO: 9120 - RNA, 23 nt, Homo sapiens
caguauuuagaaagcaguaccag

SEQ ID NO: 9121 - RNA, 23 nt, Homo sapiens
aguauuuagaaagcaguaccagu

SEQ ID NO: 9122 - RNA, 23 nt, Homo sapiens
guauuuagaaagcaguaccagua

SEQ ID NO: 9123 - RNA, 23 nt, Homo sapiens
uauuuagaaagcaguaccaguaa

SEQ ID NO: 9124 - RNA, 23 nt, Homo sapiens
auuuagaaagcaguaccaguaaa

SEQ ID NO: 9125 - RNA, 23 nt, Homo sapiens
uuuagaaagcaguaccaguaaac

SEQ ID NO: 9126 - RNA, 23 nt, Homo sapiens
uuagaaagcaguaccaguaaacg

SEQ ID NO: 9127 - RNA, 23 nt, Homo sapiens
uagaaagcaguaccaguaaacgu

SEQ ID NO: 9128 - RNA, 23 nt, Homo sapiens
agaaagcaguaccaguaaacguu

SEQ ID NO: 9129 - RNA, 23 nt, Homo sapiens
gaaagcaguaccaguaaacguua

SEQ ID NO: 9130 - RNA, 23 nt, Homo sapiens
aaagcaguaccaguaaacguuau

SEQ ID NO: 9131 - RNA, 23 nt, Homo sapiens
aagcaguaccaguaaacguuauu

SEQ ID NO: 9132 - RNA, 23 nt, Homo sapiens
agcaguaccaguaaacguuauua

SEQ ID NO: 9133 - RNA, 23 nt, Homo sapiens
gcaguaccaguaaacguuauuac

SEQ ID NO: 9134 - RNA, 23 nt, Homo sapiens
caguaccaguaaacguuauuaca

SEQ ID NO: 9135 - RNA, 23 nt, Homo sapiens
aguaccaguaaacguuauuacaa

SEQ ID NO: 9136 - RNA, 23 nt, Homo sapiens
guaccaguaaacguuauuacaag

SEQ ID NO: 9137 - RNA, 23 nt, Homo sapiens
uaccaguaaacguuauuacaagc

SEQ ID NO: 9138 - RNA, 23 nt, Homo sapiens
accaguaaacguuauuacaagca

SEQ ID NO: 9139 - RNA, 23 nt, Homo sapiens
ccaguaaacguuauuacaagcau

SEQ ID NO: 9140 - RNA, 23 nt, Homo sapiens
caguaaacguuauuacaagcauu

SEQ ID NO: 9141 - RNA, 23 nt, Homo sapiens
aguaaacguuauuacaagcauua

SEQ ID NO: 9142 - RNA, 23 nt, Homo sapiens
guaaacguuauuacaagcauuag

SEQ ID NO: 9143 - RNA, 23 nt, Homo sapiens
uaaacguuauuacaagcauuaga

SEQ ID NO: 9144 - RNA, 23 nt, Homo sapiens
aaacguuauuacaagcauuagau

SEQ ID NO: 9145 - RNA, 23 nt, Homo sapiens
aacguuauuacaagcauuagaug

SEQ ID NO: 9146 - RNA, 23 nt, Homo sapiens
acguuauuacaagcauuagaugu

SEQ ID NO: 9147 - RNA, 23 nt, Homo sapiens
cguuauuacaagcauuagaugug

SEQ ID NO: 9148 - RNA, 23 nt, Homo sapiens
guuauuacaagcauuagaugugu

SEQ ID NO: 9149 - RNA, 23 nt, Homo sapiens
uuauuacaagcauuagauguguu

SEQ ID NO: 9150 - RNA, 23 nt, Homo sapiens
uauuacaagcauuagauguguuu

SEQ ID NO: 9151 - RNA, 23 nt, Homo sapiens
auuacaagcauuagauguguuua

SEQ ID NO: 9152 - RNA, 23 nt, Homo sapiens
uuacaagcauuagauguguuuaa

SEQ ID NO: 9153 - RNA, 23 nt, Homo sapiens
uacaagcauuagauguguuuaaa

SEQ ID NO: 9154 - RNA, 23 nt, Homo sapiens
acaagcauuagauguguuuaaaa

SEQ ID NO: 9155 - RNA, 23 nt, Homo sapiens
caagcauuagauguguuuaaaaa

SEQ ID NO: 9156 - RNA, 23 nt, Homo sapiens
aagcauuagauguguuuaaaaag

SEQ ID NO: 9157 - RNA, 23 nt, Homo sapiens
agcauuagauguguuuaaaaagu

SEQ ID NO: 9158 - RNA, 23 nt, Homo sapiens
gcauuagauguguuuaaaaaguu

SEQ ID NO: 9159 - RNA, 23 nt, Homo sapiens
cauuagauguguuuaaaaaguug

SEQ ID NO: 9160 - RNA, 23 nt, Homo sapiens
auuagauguguuuaaaaaguuga

SEQ ID NO: 9161 - RNA, 23 nt, Homo sapiens
uuagauguguuuaaaaaguugau

SEQ ID NO: 9162 - RNA, 23 nt, Homo sapiens
uagauguguuuaaaaaguugaua

SEQ ID NO: 9163 - RNA, 23 nt, Homo sapiens
agauguguuuaaaaaguugauac

SEQ ID NO: 9164 - RNA, 23 nt, Homo sapiens
gauguguuuaaaaaguugauacu

SEQ ID NO: 9165 - RNA, 23 nt, Homo sapiens
auguguuuaaaaaguugauacua

SEQ ID NO: 9166 - RNA, 23 nt, Homo sapiens
uguguuuaaaaaguugauacuaa

SEQ ID NO: 9167 - RNA, 23 nt, Homo sapiens
guguuuaaaaaguugauacuaau

SEQ ID NO: 9168 - RNA, 23 nt, Homo sapiens
uguuuaaaaaguugauacuaauu

SEQ ID NO: 9169 - RNA, 23 nt, Homo sapiens
guuuaaaaaguugauacuaauuu

SEQ ID NO: 9170 - RNA, 23 nt, Homo sapiens
uuuaaaaaguugauacuaauuua

SEQ ID NO: 9171 - RNA, 23 nt, Homo sapiens
uuaaaaaguugauacuaauuuau

SEQ ID NO: 9172 - RNA, 23 nt, Homo sapiens
uaaaaaguugauacuaauuuaua

SEQ ID NO: 9173 - RNA, 23 nt, Homo sapiens
aaaaaguugauacuaauuuauaa

SEQ ID NO: 9174 - RNA, 23 nt, Homo sapiens
aaaaguugauacuaauuuauaac

SEQ ID NO: 9175 - RNA, 23 nt, Homo sapiens
aaaguugauacuaauuuauaacc

SEQ ID NO: 9176 - RNA, 23 nt, Homo sapiens
aaguugauacuaauuuauaaccu

SEQ ID NO: 9177 - RNA, 23 nt, Homo sapiens
aguugauacuaauuuauaaccug

SEQ ID NO: 9178 - RNA, 23 nt, Homo sapiens
guugauacuaauuuauaaccugu

SEQ ID NO: 9179 - RNA, 23 nt, Homo sapiens
uugauacuaauuuauaaccugua

SEQ ID NO: 9180 - RNA, 23 nt, Homo sapiens
ugauacuaauuuauaaccuguaa

SEQ ID NO: 9181 - RNA, 23 nt, Homo sapiens
gauacuaauuuauaaccuguaau

SEQ ID NO: 9182 - RNA, 23 nt, Homo sapiens
auacuaauuuauaaccuguaauu

SEQ ID NO: 9183 - RNA, 23 nt, Homo sapiens
uacuaauuuauaaccuguaauug

SEQ ID NO: 9184 - RNA, 23 nt, Homo sapiens
acuaauuuauaaccuguaauugu

SEQ ID NO: 9185 - RNA, 23 nt, Homo sapiens
cuaauuuauaaccuguaauuguu

SEQ ID NO: 9186 - RNA, 23 nt, Homo sapiens
uaauuuauaaccuguaauuguua

SEQ ID NO: 9187 - RNA, 23 nt, Homo sapiens
aauuuauaaccuguaauuguuaa

SEQ ID NO: 9188 - RNA, 23 nt, Homo sapiens
auuuauaaccuguaauuguuaaa

SEQ ID NO: 9189 - RNA, 23 nt, Homo sapiens
uuuauaaccuguaauuguuaaau

SEQ ID NO: 9190 - RNA, 23 nt, Homo sapiens
uuauaaccuguaauuguuaaaug

SEQ ID NO: 9191 - RNA, 23 nt, Homo sapiens
uauaaccuguaauuguuaaaugu

SEQ ID NO: 9192 - RNA, 23 nt, Homo sapiens
auaaccuguaauuguuaaaugug

SEQ ID NO: 9193 - RNA, 23 nt, Homo sapiens
uaaccuguaauuguuaaaugugc

SEQ ID NO: 9194 - RNA, 23 nt, Homo sapiens
aaccuguaauuguuaaaugugca

SEQ ID NO: 9195 - RNA, 23 nt, Homo sapiens
accuguaauuguuaaaugugcau

SEQ ID NO: 9196 - RNA, 23 nt, Homo sapiens
ccuguaauuguuaaaugugcaug

SEQ ID NO: 9197 - RNA, 23 nt, Homo sapiens
cuguaauuguuaaaugugcauga

SEQ ID NO: 9198 - RNA, 23 nt, Homo sapiens
uguaauuguuaaaugugcaugac

SEQ ID NO: 9199 - RNA, 23 nt, Homo sapiens
guaauuguuaaaugugcaugacu

SEQ ID NO: 9200 - RNA, 23 nt, Homo sapiens
uaauuguuaaaugugcaugacuu

SEQ ID NO: 9201 - RNA, 23 nt, Homo sapiens
aauuguuaaaugugcaugacuua

SEQ ID NO: 9202 - RNA, 23 nt, Homo sapiens
auuguuaaaugugcaugacuuaa

SEQ ID NO: 9203 - RNA, 23 nt, Homo sapiens
uuguuaaaugugcaugacuuaaa

SEQ ID NO: 9204 - RNA, 23 nt, Homo sapiens
uguuaaaugugcaugacuuaaau

SEQ ID NO: 9205 - RNA, 23 nt, Homo sapiens
guuaaaugugcaugacuuaaaug

SEQ ID NO: 9206 - RNA, 23 nt, Homo sapiens
uuaaaugugcaugacuuaaaugu

SEQ ID NO: 9207 - RNA, 23 nt, Homo sapiens
uaaaugugcaugacuuaaauguu

SEQ ID NO: 9208 - RNA, 23 nt, Homo sapiens
aaaugugcaugacuuaaauguua

SEQ ID NO: 9209 - RNA, 23 nt, Homo sapiens
aaugugcaugacuuaaauguuaa

SEQ ID NO: 9210 - RNA, 23 nt, Homo sapiens
augugcaugacuuaaauguuaaa

SEQ ID NO: 9211 - RNA, 23 nt, Homo sapiens
ugugcaugacuuaaauguuaaaa

SEQ ID NO: 9212 - RNA, 23 nt, Homo sapiens
gugcaugacuuaaauguuaaaau

SEQ ID NO: 9213 - RNA, 23 nt, Homo sapiens
ugcaugacuuaaauguuaaaauc

SEQ ID NO: 9214 - RNA, 23 nt, Homo sapiens
gcaugacuuaaauguuaaaaucc

SEQ ID NO: 9215 - RNA, 23 nt, Homo sapiens
caugacuuaaauguuaaaauccu

SEQ ID NO: 9216 - RNA, 23 nt, Homo sapiens
augacuuaaauguuaaaauccug

SEQ ID NO: 9217 - RNA, 23 nt, Homo sapiens
ugacuuaaauguuaaaauccugu

SEQ ID NO: 9218 - RNA, 23 nt, Homo sapiens
gacuuaaauguuaaaauccugua

SEQ ID NO: 9219 - RNA, 23 nt, Homo sapiens
acuuaaauguuaaaauccuguau

SEQ ID NO: 9220 - RNA, 23 nt, Homo sapiens
cuuaaauguuaaaauccuguauu

SEQ ID NO: 9221 - RNA, 23 nt, Homo sapiens
uuaaauguuaaaauccuguauuu

SEQ ID NO: 9222 - RNA, 23 nt, Homo sapiens
uaaauguuaaaauccuguauuuu

SEQ ID NO: 9223 - RNA, 23 nt, Homo sapiens
aaauguuaaaauccuguauuuua

SEQ ID NO: 9224 - RNA, 23 nt, Homo sapiens
aauguuaaaauccuguauuuuaa

SEQ ID NO: 9225 - RNA, 23 nt, Homo sapiens
auguuaaaauccuguauuuuaag

SEQ ID NO: 9226 - RNA, 23 nt, Homo sapiens
uguuaaaauccuguauuuuaaga

SEQ ID NO: 9227 - RNA, 23 nt, Homo sapiens
guuaaaauccuguauuuuaagau

SEQ ID NO: 9228 - RNA, 23 nt, Homo sapiens
uuaaaauccuguauuuuaagaua

SEQ ID NO: 9229 - RNA, 23 nt, Homo sapiens
uaaaauccuguauuuuaagauag

SEQ ID NO: 9230 - RNA, 23 nt, Homo sapiens
aaaauccuguauuuuaagauagu

SEQ ID NO: 9231 - RNA, 23 nt, Homo sapiens
aaauccuguauuuuaagauaguc

SEQ ID NO: 9232 - RNA, 23 nt, Homo sapiens
aauccuguauuuuaagauagucu

SEQ ID NO: 9233 - RNA, 23 nt, Homo sapiens
auccuguauuuuaagauagucuu

SEQ ID NO: 9234 - RNA, 23 nt, Homo sapiens
uccuguauuuuaagauagucuuc

SEQ ID NO: 9235 - RNA, 23 nt, Homo sapiens
ccuguauuuuaagauagucuucu

SEQ ID NO: 9236 - RNA, 23 nt, Homo sapiens
cuguauuuuaagauagucuucug

SEQ ID NO: 9237 - RNA, 23 nt, Homo sapiens
uguauuuuaagauagucuucugc

SEQ ID NO: 9238 - RNA, 23 nt, Homo sapiens
guauuuuaagauagucuucugca

SEQ ID NO: 9239 - RNA, 23 nt, Homo sapiens
uauuuuaagauagucuucugcag

SEQ ID NO: 9240 - RNA, 23 nt, Homo sapiens
auuuuaagauagucuucugcagu

SEQ ID NO: 9241 - RNA, 23 nt, Homo sapiens
uuuuaagauagucuucugcaguu

SEQ ID NO: 9242 - RNA, 23 nt, Homo sapiens
uuuaagauagucuucugcaguua

SEQ ID NO: 9243 - RNA, 23 nt, Homo sapiens
uuaagauagucuucugcaguuac

SEQ ID NO: 9244 - RNA, 23 nt, Homo sapiens
uaagauagucuucugcaguuaca

SEQ ID NO: 9245 - RNA, 23 nt, Homo sapiens
aagauagucuucugcaguuacaa

SEQ ID NO: 9246 - RNA, 23 nt, Homo sapiens
agauagucuucugcaguuacaaa

SEQ ID NO: 9247 - RNA, 23 nt, Homo sapiens
gauagucuucugcaguuacaaau

SEQ ID NO: 9248 - RNA, 23 nt, Homo sapiens
auagucuucugcaguuacaaauc

SEQ ID NO: 9249 - RNA, 23 nt, Homo sapiens
uagucuucugcaguuacaaaucc

SEQ ID NO: 9250 - RNA, 23 nt, Homo sapiens
agucuucugcaguuacaaaucca

SEQ ID NO: 9251 - RNA, 23 nt, Homo sapiens
gucuucugcaguuacaaauccau

SEQ ID NO: 9252 - RNA, 23 nt, Homo sapiens
ucuucugcaguuacaaauccaua

SEQ ID NO: 9253 - RNA, 23 nt, Homo sapiens
cuucugcaguuacaaauccauau

SEQ ID NO: 9254 - RNA, 23 nt, Homo sapiens
uucugcaguuacaaauccauaua

SEQ ID NO: 9255 - RNA, 23 nt, Homo sapiens
ucugcaguuacaaauccauauac

SEQ ID NO: 9256 - RNA, 23 nt, Homo sapiens
cugcaguuacaaauccauauacc

SEQ ID NO: 9257 - RNA, 23 nt, Homo sapiens
ugcaguuacaaauccauauaccc

SEQ ID NO: 9258 - RNA, 23 nt, Homo sapiens
gcaguuacaaauccauauaccca

SEQ ID NO: 9259 - RNA, 23 nt, Homo sapiens
caguuacaaauccauauacccag

SEQ ID NO: 9260 - RNA, 23 nt, Homo sapiens
aguuacaaauccauauacccaga

SEQ ID NO: 9261 - RNA, 23 nt, Homo sapiens
guuacaaauccauauacccagau

SEQ ID NO: 9262 - RNA, 23 nt, Homo sapiens
uuacaaauccauauacccagauu

SEQ ID NO: 9263 - RNA, 23 nt, Homo sapiens
uacaaauccauauacccagauuu

SEQ ID NO: 9264 - RNA, 23 nt, Homo sapiens
acaaauccauauacccagauuuc

SEQ ID NO: 9265 - RNA, 23 nt, Homo sapiens
caaauccauauacccagauuucc

SEQ ID NO: 9266 - RNA, 23 nt, Homo sapiens
aaauccauauacccagauuuccu

SEQ ID NO: 9267 - RNA, 23 nt, Homo sapiens
aauccauauacccagauuuccug

SEQ ID NO: 9268 - RNA, 23 nt, Homo sapiens
auccauauacccagauuuccugu

SEQ ID NO: 9269 - RNA, 23 nt, Homo sapiens
uccauauacccagauuuccugua

SEQ ID NO: 9270 - RNA, 23 nt, Homo sapiens
ccauauacccagauuuccuguag

SEQ ID NO: 9271 - RNA, 23 nt, Homo sapiens
cauauacccagauuuccuguagg

SEQ ID NO: 9272 - RNA, 23 nt, Homo sapiens
auauacccagauuuccuguaggc

SEQ ID NO: 9273 - RNA, 23 nt, Homo sapiens
uauacccagauuuccuguaggcu

SEQ ID NO: 9274 - RNA, 23 nt, Homo sapiens
auacccagauuuccuguaggcuu

SEQ ID NO: 9275 - RNA, 23 nt, Homo sapiens
uacccagauuuccuguaggcuuc

SEQ ID NO: 9276 - RNA, 23 nt, Homo sapiens
acccagauuuccuguaggcuuca

SEQ ID NO: 9277 - RNA, 23 nt, Homo sapiens
cccagauuuccuguaggcuucac

SEQ ID NO: 9278 - RNA, 23 nt, Homo sapiens
ccagauuuccuguaggcuucaca

SEQ ID NO: 9279 - RNA, 23 nt, Homo sapiens
cagauuuccuguaggcuucacaa

SEQ ID NO: 9280 - RNA, 23 nt, Homo sapiens
agauuuccuguaggcuucacaaa

SEQ ID NO: 9281 - RNA, 23 nt, Homo sapiens
gauuuccuguaggcuucacaaau

SEQ ID NO: 9282 - RNA, 23 nt, Homo sapiens
auuuccuguaggcuucacaaauc

SEQ ID NO: 9283 - RNA, 23 nt, Homo sapiens
uuuccuguaggcuucacaaaucg

SEQ ID NO: 9284 - RNA, 23 nt, Homo sapiens
uuccuguaggcuucacaaaucgg

SEQ ID NO: 9285 - RNA, 23 nt, Homo sapiens
uccuguaggcuucacaaaucgga

SEQ ID NO: 9286 - RNA, 23 nt, Homo sapiens
ccuguaggcuucacaaaucggag

SEQ ID NO: 9287 - RNA, 23 nt, Homo sapiens
cuguaggcuucacaaaucggagg

SEQ ID NO: 9288 - RNA, 23 nt, Homo sapiens
uguaggcuucacaaaucggaggg

SEQ ID NO: 9289 - RNA, 23 nt, Homo sapiens
guaggcuucacaaaucggagggg

SEQ ID NO: 9290 - RNA, 23 nt, Homo sapiens
uaggcuucacaaaucggaggggu

SEQ ID NO: 9291 - RNA, 23 nt, Homo sapiens
aggcuucacaaaucggaggggua

SEQ ID NO: 9292 - RNA, 23 nt, Homo sapiens
ggcuucacaaaucggagggguac

SEQ ID NO: 9293 - RNA, 23 nt, Homo sapiens
gcuucacaaaucggagggguaca

SEQ ID NO: 9294 - RNA, 23 nt, Homo sapiens
cuucacaaaucggagggguacau

SEQ ID NO: 9295 - RNA, 23 nt, Homo sapiens
uucacaaaucggagggguacaua

SEQ ID NO: 9296 - RNA, 23 nt, Homo sapiens
ucacaaaucggagggguacauag

SEQ ID NO: 9297 - RNA, 23 nt, Homo sapiens
cacaaaucggagggguacauaga

SEQ ID NO: 9298 - RNA, 23 nt, Homo sapiens
acaaaucggagggguacauagaa

SEQ ID NO: 9299 - RNA, 23 nt, Homo sapiens
caaaucggagggguacauagaau

SEQ ID NO: 9300 - RNA, 23 nt, Homo sapiens
aaaucggagggguacauagaaug

SEQ ID NO: 9301 - RNA, 23 nt, Homo sapiens
aaucggagggguacauagaaugu

SEQ ID NO: 9302 - RNA, 23 nt, Homo sapiens
aucggagggguacauagaaugug

SEQ ID NO: 9303 - RNA, 23 nt, Homo sapiens
ucggagggguacauagaaugugc

SEQ ID NO: 9304 - RNA, 23 nt, Homo sapiens
cggagggguacauagaaugugca

SEQ ID NO: 9305 - RNA, 23 nt, Homo sapiens
ggagggguacauagaaugugcaa

SEQ ID NO: 9306 - RNA, 23 nt, Homo sapiens
gagggguacauagaaugugcaag

SEQ ID NO: 9307 - RNA, 23 nt, Homo sapiens
agggguacauagaaugugcaaga

SEQ ID NO: 9308 - RNA, 23 nt, Homo sapiens
gggguacauagaaugugcaagag

SEQ ID NO: 9309 - RNA, 23 nt, Homo sapiens
ggguacauagaaugugcaagagu

SEQ ID NO: 9310 - RNA, 23 nt, Homo sapiens
gguacauagaaugugcaagaguc

SEQ ID NO: 9311 - RNA, 23 nt, Homo sapiens
guacauagaaugugcaagaguca

SEQ ID NO: 9312 - RNA, 23 nt, Homo sapiens
uacauagaaugugcaagagucaa

SEQ ID NO: 9313 - RNA, 23 nt, Homo sapiens
acauagaaugugcaagagucaaa

SEQ ID NO: 9314 - RNA, 23 nt, Homo sapiens
cauagaaugugcaagagucaaag

SEQ ID NO: 9315 - RNA, 23 nt, Homo sapiens
auagaaugugcaagagucaaagg

SEQ ID NO: 9316 - RNA, 23 nt, Homo sapiens
uagaaugugcaagagucaaagga

SEQ ID NO: 9317 - RNA, 23 nt, Homo sapiens
agaaugugcaagagucaaaggau

SEQ ID NO: 9318 - RNA, 23 nt, Homo sapiens
gaaugugcaagagucaaaggaua

SEQ ID NO: 9319 - RNA, 23 nt, Homo sapiens
aaugugcaagagucaaaggauaa

SEQ ID NO: 9320 - RNA, 23 nt, Homo sapiens
augugcaagagucaaaggauaaa

SEQ ID NO: 9321 - RNA, 23 nt, Homo sapiens
ugugcaagagucaaaggauaaau

SEQ ID NO: 9322 - RNA, 23 nt, Homo sapiens
gugcaagagucaaaggauaaaua

SEQ ID NO: 9323 - RNA, 23 nt, Homo sapiens
ugcaagagucaaaggauaaauaa

SEQ ID NO: 9324 - RNA, 23 nt, Homo sapiens
gcaagagucaaaggauaaauaau

SEQ ID NO: 9325 - RNA, 23 nt, Homo sapiens
caagagucaaaggauaaauaaua

SEQ ID NO: 9326 - RNA, 23 nt, Homo sapiens
aagagucaaaggauaaauaauau

SEQ ID NO: 9327 - RNA, 23 nt, Homo sapiens
agagucaaaggauaaauaauauu

SEQ ID NO: 9328 - RNA, 23 nt, Homo sapiens
gagucaaaggauaaauaauauua

SEQ ID NO: 9329 - RNA, 23 nt, Homo sapiens
agucaaaggauaaauaauauuau

SEQ ID NO: 9330 - RNA, 23 nt, Homo sapiens
gucaaaggauaaauaauauuaua

SEQ ID NO: 9331 - RNA, 23 nt, Homo sapiens
ucaaaggauaaauaauauuauaa

SEQ ID NO: 9332 - RNA, 23 nt, Homo sapiens
caaaggauaaauaauauuauaaa

SEQ ID NO: 9333 - RNA, 23 nt, Homo sapiens
aaaggauaaauaauauuauaaau

SEQ ID NO: 9334 - RNA, 23 nt, Homo sapiens
aaggauaaauaauauuauaaaua

SEQ ID NO: 9335 - RNA, 23 nt, Homo sapiens
aggauaaauaauauuauaaauau

SEQ ID NO: 9336 - RNA, 23 nt, Homo sapiens
ggauaaauaauauuauaaauaua

SEQ ID NO: 9337 - RNA, 23 nt, Homo sapiens
gauaaauaauauuauaaauauau

SEQ ID NO: 9338 - RNA, 23 nt, Homo sapiens
auaaauaauauuauaaauauaua

SEQ ID NO: 9339 - RNA, 23 nt, Homo sapiens
uaaauaauauuauaaauauauau

SEQ ID NO: 9340 - RNA, 23 nt, Homo sapiens
aaauaauauuauaaauauauauu

SEQ ID NO: 9341 - RNA, 23 nt, Homo sapiens
aauaauauuauaaauauauauua

SEQ ID NO: 9342 - RNA, 23 nt, Homo sapiens
auaauauuauaaauauauauuaa

SEQ ID NO: 9343 - RNA, 23 nt, Homo sapiens
uaauauuauaaauauauauuaac

SEQ ID NO: 9344 - RNA, 23 nt, Homo sapiens
aauauuauaaauauauauuaacu

SEQ ID NO: 9345 - RNA, 23 nt, Homo sapiens
auauuauaaauauauauuaacua

SEQ ID NO: 9346 - RNA, 23 nt, Homo sapiens
uauuauaaauauauauuaacuau

SEQ ID NO: 9347 - RNA, 23 nt, Homo sapiens
auuauaaauauauauuaacuaua

SEQ ID NO: 9348 - RNA, 23 nt, Homo sapiens
uuauaaauauauauuaacuauau

SEQ ID NO: 9349 - RNA, 23 nt, Homo sapiens
uauaaauauauauuaacuauauu

SEQ ID NO: 9350 - RNA, 23 nt, Homo sapiens
auaaauauauauuaacuauauua

SEQ ID NO: 9351 - RNA, 23 nt, Homo sapiens
uaaauauauauuaacuauauuac

SEQ ID NO: 9352 - RNA, 23 nt, Homo sapiens
aaauauauauuaacuauauuacc

SEQ ID NO: 9353 - RNA, 23 nt, Homo sapiens
aauauauauuaacuauauuaccu

SEQ ID NO: 9354 - RNA, 23 nt, Homo sapiens
auauauauuaacuauauuaccua

SEQ ID NO: 9355 - RNA, 23 nt, Homo sapiens
uauauauuaacuauauuaccuaa

SEQ ID NO: 9356 - RNA, 23 nt, Homo sapiens
auauauuaacuauauuaccuaau

SEQ ID NO: 9357 - RNA, 23 nt, Homo sapiens
uauauuaacuauauuaccuaauu

SEQ ID NO: 9358 - RNA, 23 nt, Homo sapiens
auauuaacuauauuaccuaauua

SEQ ID NO: 9359 - RNA, 23 nt, Homo sapiens
uauuaacuauauuaccuaauuaa

SEQ ID NO: 9360 - RNA, 23 nt, Homo sapiens
auuaacuauauuaccuaauuaaa

SEQ ID NO: 9361 - RNA, 23 nt, Homo sapiens
uuaacuauauuaccuaauuaaaa

SEQ ID NO: 9362 - RNA, 23 nt, Homo sapiens
uaacuauauuaccuaauuaaaac

SEQ ID NO: 9363 - RNA, 23 nt, Homo sapiens
aacuauauuaccuaauuaaaacc

SEQ ID NO: 9364 - RNA, 23 nt, Homo sapiens
acuauauuaccuaauuaaaacca

SEQ ID NO: 9365 - RNA, 23 nt, Homo sapiens
cuauauuaccuaauuaaaaccau

SEQ ID NO: 9366 - RNA, 23 nt, Homo sapiens
uauauuaccuaauuaaaaccaua

SEQ ID NO: 9367 - RNA, 23 nt, Homo sapiens
auauuaccuaauuaaaaccauaa

SEQ ID NO: 9368 - RNA, 23 nt, Homo sapiens
uauuaccuaauuaaaaccauaau

SEQ ID NO: 9369 - RNA, 23 nt, Homo sapiens
auuaccuaauuaaaaccauaauc

SEQ ID NO: 9370 - RNA, 23 nt, Homo sapiens
uuaccuaauuaaaaccauaaucu

SEQ ID NO: 9371 - RNA, 23 nt, Homo sapiens
uaccuaauuaaaaccauaaucug

SEQ ID NO: 9372 - RNA, 23 nt, Homo sapiens
accuaauuaaaaccauaaucugu

SEQ ID NO: 9373 - RNA, 23 nt, Homo sapiens
ccuaauuaaaaccauaaucuguu

SEQ ID NO: 9374 - RNA, 23 nt, Homo sapiens
cuaauuaaaaccauaaucuguua

SEQ ID NO: 9375 - RNA, 23 nt, Homo sapiens
uaauuaaaaccauaaucuguuaa

SEQ ID NO: 9376 - RNA, 23 nt, Homo sapiens
aauuaaaaccauaaucuguuaau

SEQ ID NO: 9377 - RNA, 23 nt, Homo sapiens
auuaaaaccauaaucuguuaaua

SEQ ID NO: 9378 - RNA, 23 nt, Homo sapiens
uuaaaaccauaaucuguuaauac

SEQ ID NO: 9379 - RNA, 23 nt, Homo sapiens
uaaaaccauaaucuguuaauaca

SEQ ID NO: 9380 - RNA, 23 nt, Homo sapiens
aaaaccauaaucuguuaauacag

SEQ ID NO: 9381 - RNA, 23 nt, Homo sapiens
aaaccauaaucuguuaauacagc

SEQ ID NO: 9382 - RNA, 23 nt, Homo sapiens
aaccauaaucuguuaauacagcu

SEQ ID NO: 9383 - RNA, 23 nt, Homo sapiens
accauaaucuguuaauacagcua

SEQ ID NO: 9384 - RNA, 23 nt, Homo sapiens
ccauaaucuguuaauacagcuau

SEQ ID NO: 9385 - RNA, 23 nt, Homo sapiens
cauaaucuguuaauacagcuaug

SEQ ID NO: 9386 - RNA, 23 nt, Homo sapiens
auaaucuguuaauacagcuaugg

SEQ ID NO: 9387 - RNA, 23 nt, Homo sapiens
uaaucuguuaauacagcuaugga

SEQ ID NO: 9388 - RNA, 23 nt, Homo sapiens
aaucuguuaauacagcuauggau

SEQ ID NO: 9389 - RNA, 23 nt, Homo sapiens
aucuguuaauacagcuauggauu

SEQ ID NO: 9390 - RNA, 23 nt, Homo sapiens
ucuguuaauacagcuauggauua

SEQ ID NO: 9391 - RNA, 23 nt, Homo sapiens
cuguuaauacagcuauggauuaa

SEQ ID NO: 9392 - RNA, 23 nt, Homo sapiens
uguuaauacagcuauggauuaau

SEQ ID NO: 9393 - RNA, 23 nt, Homo sapiens
guuaauacagcuauggauuaauu

SEQ ID NO: 9394 - RNA, 23 nt, Homo sapiens
uuaauacagcuauggauuaauuu

SEQ ID NO: 9395 - RNA, 23 nt, Homo sapiens
uaauacagcuauggauuaauuuc

SEQ ID NO: 9396 - RNA, 23 nt, Homo sapiens
aauacagcuauggauuaauuuca

SEQ ID NO: 9397 - RNA, 23 nt, Homo sapiens
auacagcuauggauuaauuucaa

SEQ ID NO: 9398 - RNA, 23 nt, Homo sapiens
uacagcuauggauuaauuucaaa

SEQ ID NO: 9399 - RNA, 23 nt, Homo sapiens
acagcuauggauuaauuucaaaa

SEQ ID NO: 9400 - RNA, 23 nt, Homo sapiens
cagcuauggauuaauuucaaaaa

SEQ ID NO: 9401 - RNA, 23 nt, Homo sapiens
agcuauggauuaauuucaaaaaa

SEQ ID NO: 9402 - RNA, 23 nt, Homo sapiens
gcuauggauuaauuucaaaaaaa

SEQ ID NO: 9403 - RNA, 23 nt, Homo sapiens
cuauggauuaauuucaaaaaaau

SEQ ID NO: 9404 - RNA, 23 nt, Homo sapiens
uauggauuaauuucaaaaaaaug

SEQ ID NO: 9405 - RNA, 23 nt, Homo sapiens
auggauuaauuucaaaaaaaugu

SEQ ID NO: 9406 - RNA, 23 nt, Homo sapiens
uggauuaauuucaaaaaaaugua

SEQ ID NO: 9407 - RNA, 23 nt, Homo sapiens
ggauuaauuucaaaaaaauguaa

SEQ ID NO: 9408 - RNA, 23 nt, Homo sapiens
gauuaauuucaaaaaaauguaau

SEQ ID NO: 9409 - RNA, 23 nt, Homo sapiens
auuaauuucaaaaaaauguaauc

SEQ ID NO: 9410 - RNA, 23 nt, Homo sapiens
uuaauuucaaaaaaauguaauca

SEQ ID NO: 9411 - RNA, 23 nt, Homo sapiens
uaauuucaaaaaaauguaaucaa

SEQ ID NO: 9412 - RNA, 23 nt, Homo sapiens
aauuucaaaaaaauguaaucaaa

SEQ ID NO: 9413 - RNA, 23 nt, Homo sapiens
auuucaaaaaaauguaaucaaau

SEQ ID NO: 9414 - RNA, 23 nt, Homo sapiens
uuucaaaaaaauguaaucaaaua

SEQ ID NO: 9415 - RNA, 23 nt, Homo sapiens
uucaaaaaaauguaaucaaauau

SEQ ID NO: 9416 - RNA, 23 nt, Homo sapiens
ucaaaaaaauguaaucaaauaua

SEQ ID NO: 9417 - RNA, 23 nt, Homo sapiens
caaaaaaauguaaucaaauauau

SEQ ID NO: 9418 - RNA, 23 nt, Homo sapiens
aaaaaaauguaaucaaauauauu

SEQ ID NO: 9419 - RNA, 23 nt, Homo sapiens
aaaaaauguaaucaaauauauua

SEQ ID NO: 9420 - RNA, 23 nt, Homo sapiens
aaaaauguaaucaaauauauuac

SEQ ID NO: 9421 - RNA, 23 nt, Homo sapiens
aaaauguaaucaaauauauuacu

SEQ ID NO: 9422 - RNA, 23 nt, Homo sapiens
aaauguaaucaaauauauuacua

SEQ ID NO: 9423 - RNA, 23 nt, Homo sapiens
aauguaaucaaauauauuacuaa

SEQ ID NO: 9424 - RNA, 23 nt, Homo sapiens
auguaaucaaauauauuacuaau

SEQ ID NO: 9425 - RNA, 23 nt, Homo sapiens
uguaaucaaauauauuacuaaug

SEQ ID NO: 9426 - RNA, 23 nt, Homo sapiens
guaaucaaauauauuacuaaugg

SEQ ID NO: 9427 - RNA, 23 nt, Homo sapiens
uaaucaaauauauuacuaauggu

SEQ ID NO: 9428 - RNA, 23 nt, Homo sapiens
aaucaaauauauuacuaauggug

SEQ ID NO: 9429 - RNA, 23 nt, Homo sapiens
aucaaauauauuacuaauggugu

SEQ ID NO: 9430 - RNA, 23 nt, Homo sapiens
ucaaauauauuacuaauggugua

SEQ ID NO: 9431 - RNA, 23 nt, Homo sapiens
caaauauauuacuaaugguguag

SEQ ID NO: 9432 - RNA, 23 nt, Homo sapiens
aaauauauuacuaaugguguagu

SEQ ID NO: 9433 - RNA, 23 nt, Homo sapiens
aauauauuacuaaugguguaguu

SEQ ID NO: 9434 - RNA, 23 nt, Homo sapiens
auauauuacuaaugguguaguug

SEQ ID NO: 9435 - RNA, 23 nt, Homo sapiens
uauauuacuaaugguguaguugg

SEQ ID NO: 9436 - RNA, 23 nt, Homo sapiens
auauuacuaaugguguaguuggc

SEQ ID NO: 9437 - RNA, 23 nt, Homo sapiens
uauuacuaaugguguaguuggcu

SEQ ID NO: 9438 - RNA, 23 nt, Homo sapiens
auuacuaaugguguaguuggcug

SEQ ID NO: 9439 - RNA, 23 nt, Homo sapiens
uuacuaaugguguaguuggcugu

SEQ ID NO: 9440 - RNA, 23 nt, Homo sapiens
uacuaaugguguaguuggcuguu

SEQ ID NO: 9441 - RNA, 23 nt, Homo sapiens
acuaaugguguaguuggcuguuu

SEQ ID NO: 9442 - RNA, 23 nt, Homo sapiens
cuaaugguguaguuggcuguuuu

SEQ ID NO: 9443 - RNA, 23 nt, Homo sapiens
uaaugguguaguuggcuguuuuc

SEQ ID NO: 9444 - RNA, 23 nt, Homo sapiens
aaugguguaguuggcuguuuucc

SEQ ID NO: 9445 - RNA, 23 nt, Homo sapiens
augguguaguuggcuguuuucca

SEQ ID NO: 9446 - RNA, 23 nt, Homo sapiens
ugguguaguuggcuguuuuccaa

SEQ ID NO: 9447 - RNA, 23 nt, Homo sapiens
gguguaguuggcuguuuuccaau

SEQ ID NO: 9448 - RNA, 23 nt, Homo sapiens
guguaguuggcuguuuuccaaug

SEQ ID NO: 9449 - RNA, 23 nt, Homo sapiens
uguaguuggcuguuuuccaaugu

SEQ ID NO: 9450 - RNA, 23 nt, Homo sapiens
guaguuggcuguuuuccaauguu

SEQ ID NO: 9451 - RNA, 23 nt, Homo sapiens
uaguuggcuguuuuccaauguug

SEQ ID NO: 9452 - RNA, 23 nt, Homo sapiens
aguuggcuguuuuccaauguugg

SEQ ID NO: 9453 - RNA, 23 nt, Homo sapiens
guuggcuguuuuccaauguuggu

SEQ ID NO: 9454 - RNA, 23 nt, Homo sapiens
uuggcuguuuuccaauguuggua

SEQ ID NO: 9455 - RNA, 23 nt, Homo sapiens
uggcuguuuuccaauguugguaa

SEQ ID NO: 9456 - RNA, 23 nt, Homo sapiens
ggcuguuuuccaauguugguaaa

SEQ ID NO: 9457 - RNA, 23 nt, Homo sapiens
gcuguuuuccaauguugguaaag

SEQ ID NO: 9458 - RNA, 23 nt, Homo sapiens
cuguuuuccaauguugguaaagu

SEQ ID NO: 9459 - RNA, 23 nt, Homo sapiens
uguuuuccaauguugguaaaguu

SEQ ID NO: 9460 - RNA, 23 nt, Homo sapiens
guuuuccaauguugguaaaguua

SEQ ID NO: 9461 - RNA, 23 nt, Homo sapiens
uuuuccaauguugguaaaguuau

SEQ ID NO: 9462 - RNA, 23 nt, Homo sapiens
uuuccaauguugguaaaguuauu

SEQ ID NO: 9463 - RNA, 23 nt, Homo sapiens
uuccaauguugguaaaguuauua

SEQ ID NO: 9464 - RNA, 23 nt, Homo sapiens
uccaauguugguaaaguuauuaa

SEQ ID NO: 9465 - RNA, 23 nt, Homo sapiens
ccaauguugguaaaguuauuaaa

SEQ ID NO: 9466 - RNA, 23 nt, Homo sapiens
caauguugguaaaguuauuaaag

SEQ ID NO: 9467 - RNA, 23 nt, Homo sapiens
aauguugguaaaguuauuaaagu

SEQ ID NO: 9468 - RNA, 23 nt, Homo sapiens
auguugguaaaguuauuaaaguu

SEQ ID NO: 9469 - RNA, 23 nt, Homo sapiens
uguugguaaaguuauuaaaguuc

SEQ ID NO: 9470 - RNA, 23 nt, Homo sapiens
guugguaaaguuauuaaaguucu

SEQ ID NO: 9471 - RNA, 23 nt, Homo sapiens
uugguaaaguuauuaaaguucuu

SEQ ID NO: 9472 - RNA, 23 nt, Homo sapiens
ugguaaaguuauuaaaguucuuc

SEQ ID NO: 9473 - RNA, 23 nt, Homo sapiens
gguaaaguuauuaaaguucuuca

SEQ ID NO: 9474 - RNA, 23 nt, Homo sapiens
guaaaguuauuaaaguucuucac

SEQ ID NO: 9475 - RNA, 23 nt, Homo sapiens
uaaaguuauuaaaguucuucacu

SEQ ID NO: 9476 - RNA, 23 nt, Homo sapiens
aaaguuauuaaaguucuucacuu

SEQ ID NO: 9477 - RNA, 23 nt, Homo sapiens
aaguuauuaaaguucuucacuuu

SEQ ID NO: 9478 - RNA, 23 nt, Homo sapiens
aguuauuaaaguucuucacuuuc

SEQ ID NO: 9479 - RNA, 23 nt, Homo sapiens
guuauuaaaguucuucacuuuca

SEQ ID NO: 9480 - RNA, 23 nt, Homo sapiens
uuauuaaaguucuucacuuucau

SEQ ID NO: 9481 - RNA, 23 nt, Homo sapiens
uauuaaaguucuucacuuucaua

SEQ ID NO: 9482 - RNA, 23 nt, Homo sapiens
auuaaaguucuucacuuucauag

SEQ ID NO: 9483 - RNA, 23 nt, Homo sapiens
uuaaaguucuucacuuucauaga

SEQ ID NO: 9484 - RNA, 23 nt, Homo sapiens
uaaaguucuucacuuucauagag

SEQ ID NO: 9485 - RNA, 23 nt, Homo sapiens
aaaguucuucacuuucauagagu

SEQ ID NO: 9486 - RNA, 23 nt, Homo sapiens
aaguucuucacuuucauagaguc

SEQ ID NO: 9487 - RNA, 23 nt, Homo sapiens
aguucuucacuuucauagagucc

SEQ ID NO: 9488 - RNA, 23 nt, Homo sapiens
guucuucacuuucauagagucca

SEQ ID NO: 9489 - RNA, 23 nt, Homo sapiens
uucuucacuuucauagaguccag

SEQ ID NO: 9490 - RNA, 23 nt, Homo sapiens
ucuucacuuucauagaguccaga

SEQ ID NO: 9491 - RNA, 23 nt, Homo sapiens
cuucacuuucauagaguccagau

SEQ ID NO: 9492 - RNA, 23 nt, Homo sapiens
uucacuuucauagaguccagauu

SEQ ID NO: 9493 - RNA, 23 nt, Homo sapiens
ucacuuucauagaguccagauug

SEQ ID NO: 9494 - RNA, 23 nt, Homo sapiens
cacuuucauagaguccagauuga

SEQ ID NO: 9495 - RNA, 23 nt, Homo sapiens
acuuucauagaguccagauugag

SEQ ID NO: 9496 - RNA, 23 nt, Homo sapiens
cuuucauagaguccagauugagc

SEQ ID NO: 9497 - RNA, 23 nt, Homo sapiens
uuucauagaguccagauugagcu

SEQ ID NO: 9498 - RNA, 23 nt, Homo sapiens
uucauagaguccagauugagcug

SEQ ID NO: 9499 - RNA, 23 nt, Homo sapiens
ucauagaguccagauugagcugc

SEQ ID NO: 9500 - RNA, 23 nt, Homo sapiens
cauagaguccagauugagcugcc

SEQ ID NO: 9501 - RNA, 23 nt, Homo sapiens
auagaguccagauugagcugcca

SEQ ID NO: 9502 - RNA, 23 nt, Homo sapiens
uagaguccagauugagcugccaa

SEQ ID NO: 9503 - RNA, 23 nt, Homo sapiens
agaguccagauugagcugccaaa

SEQ ID NO: 9504 - RNA, 23 nt, Homo sapiens
gaguccagauugagcugccaaac

SEQ ID NO: 9505 - RNA, 23 nt, Homo sapiens
aguccagauugagcugccaaacg

SEQ ID NO: 9506 - RNA, 23 nt, Homo sapiens
guccagauugagcugccaaacgc

SEQ ID NO: 9507 - RNA, 23 nt, Homo sapiens
uccagauugagcugccaaacgcu

SEQ ID NO: 9508 - RNA, 23 nt, Homo sapiens
ccagauugagcugccaaacgcug

SEQ ID NO: 9509 - RNA, 23 nt, Homo sapiens
cagauugagcugccaaacgcuga

SEQ ID NO: 9510 - RNA, 23 nt, Homo sapiens
agauugagcugccaaacgcugaa

SEQ ID NO: 9511 - RNA, 23 nt, Homo sapiens
gauugagcugccaaacgcugaaa

SEQ ID NO: 9512 - RNA, 23 nt, Homo sapiens
auugagcugccaaacgcugaaau

SEQ ID NO: 9513 - RNA, 23 nt, Homo sapiens
uugagcugccaaacgcugaaauu

SEQ ID NO: 9514 - RNA, 23 nt, Homo sapiens
ugagcugccaaacgcugaaauuc

SEQ ID NO: 9515 - RNA, 23 nt, Homo sapiens
gagcugccaaacgcugaaauucu

SEQ ID NO: 9516 - RNA, 23 nt, Homo sapiens
agcugccaaacgcugaaauucuc

SEQ ID NO: 9517 - RNA, 23 nt, Homo sapiens
gcugccaaacgcugaaauucucc

SEQ ID NO: 9518 - RNA, 23 nt, Homo sapiens
cugccaaacgcugaaauucuccu

SEQ ID NO: 9519 - RNA, 23 nt, Homo sapiens
ugccaaacgcugaaauucuccuu

SEQ ID NO: 9520 - RNA, 23 nt, Homo sapiens
gccaaacgcugaaauucuccuuc

SEQ ID NO: 9521 - RNA, 23 nt, Homo sapiens
ccaaacgcugaaauucuccuucu

SEQ ID NO: 9522 - RNA, 23 nt, Homo sapiens
caaacgcugaaauucuccuucug

SEQ ID NO: 9523 - RNA, 23 nt, Homo sapiens
aaacgcugaaauucuccuucugg

SEQ ID NO: 9524 - RNA, 23 nt, Homo sapiens
aacgcugaaauucuccuucuggg

SEQ ID NO: 9525 - RNA, 23 nt, Homo sapiens
acgcugaaauucuccuucugggu

SEQ ID NO: 9526 - RNA, 23 nt, Homo sapiens
cgcugaaauucuccuucuggguu

SEQ ID NO: 9527 - RNA, 23 nt, Homo sapiens
gcugaaauucuccuucuggguua

SEQ ID NO: 9528 - RNA, 23 nt, Homo sapiens
cugaaauucuccuucuggguuaa

SEQ ID NO: 9529 - RNA, 23 nt, Homo sapiens
ugaaauucuccuucuggguuaaa

SEQ ID NO: 9530 - RNA, 23 nt, Homo sapiens
gaaauucuccuucuggguuaaaa

SEQ ID NO: 9531 - RNA, 23 nt, Homo sapiens
aaauucuccuucuggguuaaaag

SEQ ID NO: 9532 - RNA, 23 nt, Homo sapiens
aauucuccuucuggguuaaaagc

SEQ ID NO: 9533 - RNA, 23 nt, Homo sapiens
auucuccuucuggguuaaaagcu

SEQ ID NO: 9534 - RNA, 23 nt, Homo sapiens
uucuccuucuggguuaaaagcuu

SEQ ID NO: 9535 - RNA, 23 nt, Homo sapiens
ucuccuucuggguuaaaagcuug

SEQ ID NO: 9536 - RNA, 23 nt, Homo sapiens
cuccuucuggguuaaaagcuugu

SEQ ID NO: 9537 - RNA, 23 nt, Homo sapiens
uccuucuggguuaaaagcuuguu

SEQ ID NO: 9538 - RNA, 23 nt, Homo sapiens
ccuucuggguuaaaagcuuguuu

SEQ ID NO: 9539 - RNA, 23 nt, Homo sapiens
cuucuggguuaaaagcuuguuuu

SEQ ID NO: 9540 - RNA, 23 nt, Homo sapiens
uucuggguuaaaagcuuguuuua

SEQ ID NO: 9541 - RNA, 23 nt, Homo sapiens
ucuggguuaaaagcuuguuuuac

SEQ ID NO: 9542 - RNA, 23 nt, Homo sapiens
cuggguuaaaagcuuguuuuaca

SEQ ID NO: 9543 - RNA, 23 nt, Homo sapiens
uggguuaaaagcuuguuuuacau

SEQ ID NO: 9544 - RNA, 23 nt, Homo sapiens
ggguuaaaagcuuguuuuacauu

SEQ ID NO: 9545 - RNA, 23 nt, Homo sapiens
gguuaaaagcuuguuuuacauuc

SEQ ID NO: 9546 - RNA, 23 nt, Homo sapiens
guuaaaagcuuguuuuacauuca

SEQ ID NO: 9547 - RNA, 23 nt, Homo sapiens
uuaaaagcuuguuuuacauucaa

SEQ ID NO: 9548 - RNA, 23 nt, Homo sapiens
uaaaagcuuguuuuacauucaaa

SEQ ID NO: 9549 - RNA, 23 nt, Homo sapiens
aaaagcuuguuuuacauucaaac

SEQ ID NO: 9550 - RNA, 23 nt, Homo sapiens
aaagcuuguuuuacauucaaacc

SEQ ID NO: 9551 - RNA, 23 nt, Homo sapiens
aagcuuguuuuacauucaaaccu

SEQ ID NO: 9552 - RNA, 23 nt, Homo sapiens
agcuuguuuuacauucaaaccuu

SEQ ID NO: 9553 - RNA, 23 nt, Homo sapiens
gcuuguuuuacauucaaaccuuu

SEQ ID NO: 9554 - RNA, 23 nt, Homo sapiens
cuuguuuuacauucaaaccuuuc

SEQ ID NO: 9555 - RNA, 23 nt, Homo sapiens
uuguuuuacauucaaaccuuucc

SEQ ID NO: 9556 - RNA, 23 nt, Homo sapiens
uguuuuacauucaaaccuuuccc

SEQ ID NO: 9557 - RNA, 23 nt, Homo sapiens
guuuuacauucaaaccuuuccca

SEQ ID NO: 9558 - RNA, 23 nt, Homo sapiens
uuuuacauucaaaccuuucccau

SEQ ID NO: 9559 - RNA, 23 nt, Homo sapiens
uuuacauucaaaccuuucccauu

SEQ ID NO: 9560 - RNA, 23 nt, Homo sapiens
uuacauucaaaccuuucccauua

SEQ ID NO: 9561 - RNA, 23 nt, Homo sapiens
uacauucaaaccuuucccauuaa

SEQ ID NO: 9562 - RNA, 23 nt, Homo sapiens
acauucaaaccuuucccauuaag

SEQ ID NO: 9563 - RNA, 23 nt, Homo sapiens
cauucaaaccuuucccauuaagu

SEQ ID NO: 9564 - RNA, 23 nt, Homo sapiens
auucaaaccuuucccauuaagug

SEQ ID NO: 9565 - RNA, 23 nt, Homo sapiens
uucaaaccuuucccauuaagugc

SEQ ID NO: 9566 - RNA, 23 nt, Homo sapiens
ucaaaccuuucccauuaagugcu

SEQ ID NO: 9567 - RNA, 23 nt, Homo sapiens
caaaccuuucccauuaagugcua

SEQ ID NO: 9568 - RNA, 23 nt, Homo sapiens
aaaccuuucccauuaagugcuaa

SEQ ID NO: 9569 - RNA, 23 nt, Homo sapiens
aaccuuucccauuaagugcuaaa

SEQ ID NO: 9570 - RNA, 23 nt, Homo sapiens
accuuucccauuaagugcuaaau

SEQ ID NO: 9571 - RNA, 23 nt, Homo sapiens
ccuuucccauuaagugcuaaaua

SEQ ID NO: 9572 - RNA, 23 nt, Homo sapiens
cuuucccauuaagugcuaaauau

SEQ ID NO: 9573 - RNA, 23 nt, Homo sapiens
uuucccauuaagugcuaaauauu

SEQ ID NO: 9574 - RNA, 23 nt, Homo sapiens
uucccauuaagugcuaaauauuu

SEQ ID NO: 9575 - RNA, 23 nt, Homo sapiens
ucccauuaagugcuaaauauuug

SEQ ID NO: 9576 - RNA, 23 nt, Homo sapiens
cccauuaagugcuaaauauuugc

SEQ ID NO: 9577 - RNA, 23 nt, Homo sapiens
ccauuaagugcuaaauauuugcu

SEQ ID NO: 9578 - RNA, 23 nt, Homo sapiens
cauuaagugcuaaauauuugcug

SEQ ID NO: 9579 - RNA, 23 nt, Homo sapiens
auuaagugcuaaauauuugcuga

SEQ ID NO: 9580 - RNA, 23 nt, Homo sapiens
uuaagugcuaaauauuugcugaa

SEQ ID NO: 9581 - RNA, 23 nt, Homo sapiens
uaagugcuaaauauuugcugaau

SEQ ID NO: 9582 - RNA, 23 nt, Homo sapiens
aagugcuaaauauuugcugaaug

SEQ ID NO: 9583 - RNA, 23 nt, Homo sapiens
agugcuaaauauuugcugaaugu

SEQ ID NO: 9584 - RNA, 23 nt, Homo sapiens
gugcuaaauauuugcugaauguu

SEQ ID NO: 9585 - RNA, 23 nt, Homo sapiens
ugcuaaauauuugcugaauguug

SEQ ID NO: 9586 - RNA, 23 nt, Homo sapiens
gcuaaauauuugcugaauguugg

SEQ ID NO: 9587 - RNA, 23 nt, Homo sapiens
cuaaauauuugcugaauguuggu

SEQ ID NO: 9588 - RNA, 23 nt, Homo sapiens
uaaauauuugcugaauguugguc

SEQ ID NO: 9589 - RNA, 23 nt, Homo sapiens
aaauauuugcugaauguuggucg

SEQ ID NO: 9590 - RNA, 23 nt, Homo sapiens
aauauuugcugaauguuggucga

SEQ ID NO: 9591 - RNA, 23 nt, Homo sapiens
auauuugcugaauguuggucgaa

SEQ ID NO: 9592 - RNA, 23 nt, Homo sapiens
uauuugcugaauguuggucgaac

SEQ ID NO: 9593 - RNA, 23 nt, Homo sapiens
auuugcugaauguuggucgaacc

SEQ ID NO: 9594 - RNA, 23 nt, Homo sapiens
uuugcugaauguuggucgaaccc

SEQ ID NO: 9595 - RNA, 23 nt, Homo sapiens
uugcugaauguuggucgaacccg

SEQ ID NO: 9596 - RNA, 23 nt, Homo sapiens
ugcugaauguuggucgaacccgu

SEQ ID NO: 9597 - RNA, 23 nt, Homo sapiens
gcugaauguuggucgaacccgua

SEQ ID NO: 9598 - RNA, 23 nt, Homo sapiens
cugaauguuggucgaacccguaa

SEQ ID NO: 9599 - RNA, 23 nt, Homo sapiens
ugaauguuggucgaacccguaac

SEQ ID NO: 9600 - RNA, 23 nt, Homo sapiens
gaauguuggucgaacccguaacu

SEQ ID NO: 9601 - RNA, 23 nt, Homo sapiens
aauguuggucgaacccguaacug

SEQ ID NO: 9602 - RNA, 23 nt, Homo sapiens
auguuggucgaacccguaacugc

SEQ ID NO: 9603 - RNA, 23 nt, Homo sapiens
uguuggucgaacccguaacugcu

SEQ ID NO: 9604 - RNA, 23 nt, Homo sapiens
guuggucgaacccguaacugcuu

SEQ ID NO: 9605 - RNA, 23 nt, Homo sapiens
uuggucgaacccguaacugcuua

SEQ ID NO: 9606 - RNA, 23 nt, Homo sapiens
uggucgaacccguaacugcuuag

SEQ ID NO: 9607 - RNA, 23 nt, Homo sapiens
ggucgaacccguaacugcuuagg

SEQ ID NO: 9608 - RNA, 23 nt, Homo sapiens
gucgaacccguaacugcuuagga

SEQ ID NO: 9609 - RNA, 23 nt, Homo sapiens
ucgaacccguaacugcuuaggag

SEQ ID NO: 9610 - RNA, 23 nt, Homo sapiens
cgaacccguaacugcuuaggagc

SEQ ID NO: 9611 - RNA, 23 nt, Homo sapiens
gaacccguaacugcuuaggagcu

SEQ ID NO: 9612 - RNA, 23 nt, Homo sapiens
aacccguaacugcuuaggagcug

SEQ ID NO: 9613 - RNA, 23 nt, Homo sapiens
acccguaacugcuuaggagcugg

SEQ ID NO: 9614 - RNA, 23 nt, Homo sapiens
cccguaacugcuuaggagcugga

SEQ ID NO: 9615 - RNA, 23 nt, Homo sapiens
ccguaacugcuuaggagcuggaa

SEQ ID NO: 9616 - RNA, 23 nt, Homo sapiens
cguaacugcuuaggagcuggaag

SEQ ID NO: 9617 - RNA, 23 nt, Homo sapiens
guaacugcuuaggagcuggaaga

SEQ ID NO: 9618 - RNA, 23 nt, Homo sapiens
uaacugcuuaggagcuggaagag

SEQ ID NO: 9619 - RNA, 23 nt, Homo sapiens
aacugcuuaggagcuggaagagu

SEQ ID NO: 9620 - RNA, 23 nt, Homo sapiens
acugcuuaggagcuggaagaguu

SEQ ID NO: 9621 - RNA, 23 nt, Homo sapiens
cugcuuaggagcuggaagaguuu

SEQ ID NO: 9622 - RNA, 23 nt, Homo sapiens
ugcuuaggagcuggaagaguuug

SEQ ID NO: 9623 - RNA, 23 nt, Homo sapiens
gcuuaggagcuggaagaguuugg

SEQ ID NO: 9624 - RNA, 23 nt, Homo sapiens
cuuaggagcuggaagaguuuggu

SEQ ID NO: 9625 - RNA, 23 nt, Homo sapiens
uuaggagcuggaagaguuugguu

SEQ ID NO: 9626 - RNA, 23 nt, Homo sapiens
uaggagcuggaagaguuugguuu

SEQ ID NO: 9627 - RNA, 23 nt, Homo sapiens
aggagcuggaagaguuugguuug

SEQ ID NO: 9628 - RNA, 23 nt, Homo sapiens
ggagcuggaagaguuugguuugg

SEQ ID NO: 9629 - RNA, 23 nt, Homo sapiens
gagcuggaagaguuugguuugga

SEQ ID NO: 9630 - RNA, 23 nt, Homo sapiens
agcuggaagaguuugguuuggac

SEQ ID NO: 9631 - RNA, 23 nt, Homo sapiens
gcuggaagaguuugguuuggacg

SEQ ID NO: 9632 - RNA, 23 nt, Homo sapiens
cuggaagaguuugguuuggacgu

SEQ ID NO: 9633 - RNA, 23 nt, Homo sapiens
uggaagaguuugguuuggacgug

SEQ ID NO: 9634 - RNA, 23 nt, Homo sapiens
ggaagaguuugguuuggacgugc

SEQ ID NO: 9635 - RNA, 23 nt, Homo sapiens
gaagaguuugguuuggacgugcc

SEQ ID NO: 9636 - RNA, 23 nt, Homo sapiens
aagaguuugguuuggacgugccg

SEQ ID NO: 9637 - RNA, 23 nt, Homo sapiens
agaguuugguuuggacgugccgu

SEQ ID NO: 9638 - RNA, 23 nt, Homo sapiens
gaguuugguuuggacgugccgua

SEQ ID NO: 9639 - RNA, 23 nt, Homo sapiens
aguuugguuuggacgugccguaa

SEQ ID NO: 9640 - RNA, 23 nt, Homo sapiens
guuugguuuggacgugccguaac

SEQ ID NO: 9641 - RNA, 23 nt, Homo sapiens
uuugguuuggacgugccguaacg

SEQ ID NO: 9642 - RNA, 23 nt, Homo sapiens
uugguuuggacgugccguaacgu

SEQ ID NO: 9643 - RNA, 23 nt, Homo sapiens
ugguuuggacgugccguaacguc

SEQ ID NO: 9644 - RNA, 23 nt, Homo sapiens
gguuuggacgugccguaacgucu

SEQ ID NO: 9645 - RNA, 23 nt, Homo sapiens
guuuggacgugccguaacgucua

SEQ ID NO: 9646 - RNA, 23 nt, Homo sapiens
uuuggacgugccguaacgucuaa

SEQ ID NO: 9647 - RNA, 23 nt, Homo sapiens
uuggacgugccguaacgucuaau

SEQ ID NO: 9648 - RNA, 23 nt, Homo sapiens
uggacgugccguaacgucuaauc

SEQ ID NO: 9649 - RNA, 23 nt, Homo sapiens
ggacgugccguaacgucuaaucu

SEQ ID NO: 9650 - RNA, 23 nt, Homo sapiens
gacgugccguaacgucuaaucuu

SEQ ID NO: 9651 - RNA, 23 nt, Homo sapiens
acgugccguaacgucuaaucuug

SEQ ID NO: 9652 - RNA, 23 nt, Homo sapiens
cgugccguaacgucuaaucuugu

SEQ ID NO: 9653 - RNA, 23 nt, Homo sapiens
gugccguaacgucuaaucuugug

SEQ ID NO: 9654 - RNA, 23 nt, Homo sapiens
ugccguaacgucuaaucuugugu

SEQ ID NO: 9655 - RNA, 23 nt, Homo sapiens
gccguaacgucuaaucuuguguu

SEQ ID NO: 9656 - RNA, 23 nt, Homo sapiens
ccguaacgucuaaucuuguguua

SEQ ID NO: 9657 - RNA, 23 nt, Homo sapiens
cguaacgucuaaucuuguguuac

SEQ ID NO: 9658 - RNA, 23 nt, Homo sapiens
guaacgucuaaucuuguguuaca

SEQ ID NO: 9659 - RNA, 23 nt, Homo sapiens
uaacgucuaaucuuguguuacau

SEQ ID NO: 9660 - RNA, 23 nt, Homo sapiens
aacgucuaaucuuguguuacaug

SEQ ID NO: 9661 - RNA, 23 nt, Homo sapiens
acgucuaaucuuguguuacaugu

SEQ ID NO: 9662 - RNA, 23 nt, Homo sapiens
cgucuaaucuuguguuacaugua

SEQ ID NO: 9663 - RNA, 23 nt, Homo sapiens
gucuaaucuuguguuacauguag

SEQ ID NO: 9664 - RNA, 23 nt, Homo sapiens
ucuaaucuuguguuacauguagu

SEQ ID NO: 9665 - RNA, 23 nt, Homo sapiens
cuaaucuuguguuacauguaguc

SEQ ID NO: 9666 - RNA, 23 nt, Homo sapiens
uaaucuuguguuacauguaguca

SEQ ID NO: 9667 - RNA, 23 nt, Homo sapiens
aaucuuguguuacauguagucac

SEQ ID NO: 9668 - RNA, 23 nt, Homo sapiens
aucuuguguuacauguagucacu

SEQ ID NO: 9669 - RNA, 23 nt, Homo sapiens
ucuuguguuacauguagucacuc

SEQ ID NO: 9670 - RNA, 23 nt, Homo sapiens
cuuguguuacauguagucacucc

SEQ ID NO: 9671 - RNA, 23 nt, Homo sapiens
uuguguuacauguagucacucca

SEQ ID NO: 9672 - RNA, 23 nt, Homo sapiens
uguguuacauguagucacuccag

SEQ ID NO: 9673 - RNA, 23 nt, Homo sapiens
guguuacauguagucacuccagc

SEQ ID NO: 9674 - RNA, 23 nt, Homo sapiens
uguuacauguagucacuccagcu

SEQ ID NO: 9675 - RNA, 23 nt, Homo sapiens
guuacauguagucacuccagcuu

SEQ ID NO: 9676 - RNA, 23 nt, Homo sapiens
uuacauguagucacuccagcuuc

SEQ ID NO: 9677 - RNA, 23 nt, Homo sapiens
uacauguagucacuccagcuuca

SEQ ID NO: 9678 - RNA, 23 nt, Homo sapiens
acauguagucacuccagcuucau

SEQ ID NO: 9679 - RNA, 23 nt, Homo sapiens
cauguagucacuccagcuucauu

SEQ ID NO: 9680 - RNA, 23 nt, Homo sapiens
auguagucacuccagcuucauua

SEQ ID NO: 9681 - RNA, 23 nt, Homo sapiens
uguagucacuccagcuucauuaa

SEQ ID NO: 9682 - RNA, 23 nt, Homo sapiens
guagucacuccagcuucauuaac

SEQ ID NO: 9683 - RNA, 23 nt, Homo sapiens
uagucacuccagcuucauuaacu

SEQ ID NO: 9684 - RNA, 23 nt, Homo sapiens
agucacuccagcuucauuaacug

SEQ ID NO: 9685 - RNA, 23 nt, Homo sapiens
gucacuccagcuucauuaacugc

SEQ ID NO: 9686 - RNA, 23 nt, Homo sapiens
ucacuccagcuucauuaacugcu

SEQ ID NO: 9687 - RNA, 23 nt, Homo sapiens
cacuccagcuucauuaacugcug

SEQ ID NO: 9688 - RNA, 23 nt, Homo sapiens
acuccagcuucauuaacugcuga

SEQ ID NO: 9689 - RNA, 23 nt, Homo sapiens
cuccagcuucauuaacugcugac

SEQ ID NO: 9690 - RNA, 23 nt, Homo sapiens
uccagcuucauuaacugcugaca

SEQ ID NO: 9691 - RNA, 23 nt, Homo sapiens
ccagcuucauuaacugcugacac

SEQ ID NO: 9692 - RNA, 23 nt, Homo sapiens
cagcuucauuaacugcugacaca

SEQ ID NO: 9693 - RNA, 23 nt, Homo sapiens
agcuucauuaacugcugacacag

SEQ ID NO: 9694 - RNA, 23 nt, Homo sapiens
gcuucauuaacugcugacacagu

SEQ ID NO: 9695 - RNA, 23 nt, Homo sapiens
cuucauuaacugcugacacagua

SEQ ID NO: 9696 - RNA, 23 nt, Homo sapiens
uucauuaacugcugacacaguau

SEQ ID NO: 9697 - RNA, 23 nt, Homo sapiens
ucauuaacugcugacacaguaua

SEQ ID NO: 9698 - RNA, 23 nt, Homo sapiens
cauuaacugcugacacaguauac

SEQ ID NO: 9699 - RNA, 23 nt, Homo sapiens
auuaacugcugacacaguauacc

SEQ ID NO: 9700 - RNA, 23 nt, Homo sapiens
uuaacugcugacacaguauacca

SEQ ID NO: 9701 - RNA, 23 nt, Homo sapiens
uaacugcugacacaguauaccac

SEQ ID NO: 9702 - RNA, 23 nt, Homo sapiens
aacugcugacacaguauaccacc

SEQ ID NO: 9703 - RNA, 23 nt, Homo sapiens
acugcugacacaguauaccaccc

SEQ ID NO: 9704 - RNA, 23 nt, Homo sapiens
cugcugacacaguauaccaccca

SEQ ID NO: 9705 - RNA, 23 nt, Homo sapiens
ugcugacacaguauaccacccag

SEQ ID NO: 9706 - RNA, 23 nt, Homo sapiens
gcugacacaguauaccacccagc

SEQ ID NO: 9707 - RNA, 23 nt, Homo sapiens
cugacacaguauaccacccagca

SEQ ID NO: 9708 - RNA, 23 nt, Homo sapiens
ugacacaguauaccacccagcau

SEQ ID NO: 9709 - RNA, 23 nt, Homo sapiens
gacacaguauaccacccagcauc

SEQ ID NO: 9710 - RNA, 23 nt, Homo sapiens
acacaguauaccacccagcaucu

SEQ ID NO: 9711 - RNA, 23 nt, Homo sapiens
cacaguauaccacccagcaucuu

SEQ ID NO: 9712 - RNA, 23 nt, Homo sapiens
acaguauaccacccagcaucuuu

SEQ ID NO: 9713 - RNA, 23 nt, Homo sapiens
caguauaccacccagcaucuuuc

SEQ ID NO: 9714 - RNA, 23 nt, Homo sapiens
aguauaccacccagcaucuuucu

SEQ ID NO: 9715 - RNA, 23 nt, Homo sapiens
guauaccacccagcaucuuucuu

SEQ ID NO: 9716 - RNA, 23 nt, Homo sapiens
uauaccacccagcaucuuucuug

SEQ ID NO: 9717 - RNA, 23 nt, Homo sapiens
auaccacccagcaucuuucuugu

SEQ ID NO: 9718 - RNA, 23 nt, Homo sapiens
uaccacccagcaucuuucuuguu

SEQ ID NO: 9719 - RNA, 23 nt, Homo sapiens
accacccagcaucuuucuuguuu

SEQ ID NO: 9720 - RNA, 23 nt, Homo sapiens
ccacccagcaucuuucuuguuua

SEQ ID NO: 9721 - RNA, 23 nt, Homo sapiens
cacccagcaucuuucuuguuuac

SEQ ID NO: 9722 - RNA, 23 nt, Homo sapiens
acccagcaucuuucuuguuuaca

SEQ ID NO: 9723 - RNA, 23 nt, Homo sapiens
cccagcaucuuucuuguuuacau

SEQ ID NO: 9724 - RNA, 23 nt, Homo sapiens
ccagcaucuuucuuguuuacauc

SEQ ID NO: 9725 - RNA, 23 nt, Homo sapiens
cagcaucuuucuuguuuacaucu

SEQ ID NO: 9726 - RNA, 23 nt, Homo sapiens
agcaucuuucuuguuuacaucuu

SEQ ID NO: 9727 - RNA, 23 nt, Homo sapiens
gcaucuuucuuguuuacaucuuu

SEQ ID NO: 9728 - RNA, 23 nt, Homo sapiens
caucuuucuuguuuacaucuuuu

SEQ ID NO: 9729 - RNA, 23 nt, Homo sapiens
aucuuucuuguuuacaucuuuua

SEQ ID NO: 9730 - RNA, 23 nt, Homo sapiens
ucuuucuuguuuacaucuuuuau

SEQ ID NO: 9731 - RNA, 23 nt, Homo sapiens
cuuucuuguuuacaucuuuuauc

SEQ ID NO: 9732 - RNA, 23 nt, Homo sapiens
uuucuuguuuacaucuuuuauca

SEQ ID NO: 9733 - RNA, 23 nt, Homo sapiens
uucuuguuuacaucuuuuaucag

SEQ ID NO: 9734 - RNA, 23 nt, Homo sapiens
ucuuguuuacaucuuuuaucagu

SEQ ID NO: 9735 - RNA, 23 nt, Homo sapiens
cuuguuuacaucuuuuaucagua

SEQ ID NO: 9736 - RNA, 23 nt, Homo sapiens
uuguuuacaucuuuuaucaguaa

SEQ ID NO: 9737 - RNA, 23 nt, Homo sapiens
uguuuacaucuuuuaucaguaaa

SEQ ID NO: 9738 - RNA, 23 nt, Homo sapiens
guuuacaucuuuuaucaguaaag

SEQ ID NO: 9739 - RNA, 23 nt, Homo sapiens
uuuacaucuuuuaucaguaaagu

SEQ ID NO: 9740 - RNA, 23 nt, Homo sapiens
uuacaucuuuuaucaguaaagua

SEQ ID NO: 9741 - RNA, 23 nt, Homo sapiens
uacaucuuuuaucaguaaaguaa

SEQ ID NO: 9742 - RNA, 23 nt, Homo sapiens
acaucuuuuaucaguaaaguaac

SEQ ID NO: 9743 - RNA, 23 nt, Homo sapiens
caucuuuuaucaguaaaguaacu

SEQ ID NO: 9744 - RNA, 23 nt, Homo sapiens
aucuuuuaucaguaaaguaacuc

SEQ ID NO: 9745 - RNA, 23 nt, Homo sapiens
ucuuuuaucaguaaaguaacucu

SEQ ID NO: 9746 - RNA, 23 nt, Homo sapiens
cuuuuaucaguaaaguaacucuu

SEQ ID NO: 9747 - RNA, 23 nt, Homo sapiens
uuuuaucaguaaaguaacucuuc

SEQ ID NO: 9748 - RNA, 23 nt, Homo sapiens
uuuaucaguaaaguaacucuucc

SEQ ID NO: 9749 - RNA, 23 nt, Homo sapiens
uuaucaguaaaguaacucuucca

SEQ ID NO: 9750 - RNA, 23 nt, Homo sapiens
uaucaguaaaguaacucuuccag

SEQ ID NO: 9751 - RNA, 23 nt, Homo sapiens
aucaguaaaguaacucuuccagu

SEQ ID NO: 9752 - RNA, 23 nt, Homo sapiens
ucaguaaaguaacucuuccagug

SEQ ID NO: 9753 - RNA, 23 nt, Homo sapiens
caguaaaguaacucuuccagugu

SEQ ID NO: 9754 - RNA, 23 nt, Homo sapiens
aguaaaguaacucuuccaguguu

SEQ ID NO: 9755 - RNA, 23 nt, Homo sapiens
guaaaguaacucuuccaguguua

SEQ ID NO: 9756 - RNA, 23 nt, Homo sapiens
uaaaguaacucuuccaguguuau

SEQ ID NO: 9757 - RNA, 23 nt, Homo sapiens
aaaguaacucuuccaguguuauc

SEQ ID NO: 9758 - RNA, 23 nt, Homo sapiens
aaguaacucuuccaguguuaucu

SEQ ID NO: 9759 - RNA, 23 nt, Homo sapiens
aguaacucuuccaguguuaucuu

SEQ ID NO: 9760 - RNA, 23 nt, Homo sapiens
guaacucuuccaguguuaucuug

SEQ ID NO: 9761 - RNA, 23 nt, Homo sapiens
uaacucuuccaguguuaucuuga

SEQ ID NO: 9762 - RNA, 23 nt, Homo sapiens
aacucuuccaguguuaucuugau

SEQ ID NO: 9763 - RNA, 23 nt, Homo sapiens
acucuuccaguguuaucuugaua

SEQ ID NO: 9764 - RNA, 23 nt, Homo sapiens
cucuuccaguguuaucuugauau

SEQ ID NO: 9765 - RNA, 23 nt, Homo sapiens
ucuuccaguguuaucuugauaua

SEQ ID NO: 9766 - RNA, 23 nt, Homo sapiens
cuuccaguguuaucuugauauaa

SEQ ID NO: 9767 - RNA, 23 nt, Homo sapiens
uuccaguguuaucuugauauaag

SEQ ID NO: 9768 - RNA, 23 nt, Homo sapiens
uccaguguuaucuugauauaagc

SEQ ID NO: 9769 - RNA, 23 nt, Homo sapiens
ccaguguuaucuugauauaagcu

SEQ ID NO: 9770 - RNA, 23 nt, Homo sapiens
caguguuaucuugauauaagcuu

SEQ ID NO: 9771 - RNA, 23 nt, Homo sapiens
aguguuaucuugauauaagcuua

SEQ ID NO: 9772 - RNA, 23 nt, Homo sapiens
guguuaucuugauauaagcuuau

SEQ ID NO: 9773 - RNA, 23 nt, Homo sapiens
uguuaucuugauauaagcuuauu

SEQ ID NO: 9774 - RNA, 23 nt, Homo sapiens
guuaucuugauauaagcuuauuc

SEQ ID NO: 9775 - RNA, 23 nt, Homo sapiens
uuaucuugauauaagcuuauucg

SEQ ID NO: 9776 - RNA, 23 nt, Homo sapiens
uaucuugauauaagcuuauucgg

SEQ ID NO: 9777 - RNA, 23 nt, Homo sapiens
aucuugauauaagcuuauucggu

SEQ ID NO: 9778 - RNA, 23 nt, Homo sapiens
ucuugauauaagcuuauucgguc

SEQ ID NO: 9779 - RNA, 23 nt, Homo sapiens
cuugauauaagcuuauucgguca

SEQ ID NO: 9780 - RNA, 23 nt, Homo sapiens
uugauauaagcuuauucggucag

SEQ ID NO: 9781 - RNA, 23 nt, Homo sapiens
ugauauaagcuuauucggucagu

SEQ ID NO: 9782 - RNA, 23 nt, Homo sapiens
gauauaagcuuauucggucagug

SEQ ID NO: 9783 - RNA, 23 nt, Homo sapiens
auauaagcuuauucggucagugu

SEQ ID NO: 9784 - RNA, 23 nt, Homo sapiens
uauaagcuuauucggucaguguu

SEQ ID NO: 9785 - RNA, 23 nt, Homo sapiens
auaagcuuauucggucaguguug

SEQ ID NO: 9786 - RNA, 23 nt, Homo sapiens
uaagcuuauucggucaguguuga

SEQ ID NO: 9787 - RNA, 23 nt, Homo sapiens
aagcuuauucggucaguguugaa

SEQ ID NO: 9788 - RNA, 23 nt, Homo sapiens
agcuuauucggucaguguugaau

SEQ ID NO: 9789 - RNA, 23 nt, Homo sapiens
gcuuauucggucaguguugaauu

SEQ ID NO: 9790 - RNA, 23 nt, Homo sapiens
cuuauucggucaguguugaauug

SEQ ID NO: 9791 - RNA, 23 nt, Homo sapiens
uuauucggucaguguugaauugu

SEQ ID NO: 9792 - RNA, 23 nt, Homo sapiens
uauucggucaguguugaauugua

SEQ ID NO: 9793 - RNA, 23 nt, Homo sapiens
auucggucaguguugaauuguac

SEQ ID NO: 9794 - RNA, 23 nt, Homo sapiens
uucggucaguguugaauuguacc

SEQ ID NO: 9795 - RNA, 23 nt, Homo sapiens
ucggucaguguugaauuguacca

SEQ ID NO: 9796 - RNA, 23 nt, Homo sapiens
cggucaguguugaauuguaccau

SEQ ID NO: 9797 - RNA, 23 nt, Homo sapiens
ggucaguguugaauuguaccauu

SEQ ID NO: 9798 - RNA, 23 nt, Homo sapiens
gucaguguugaauuguaccauuu

SEQ ID NO: 9799 - RNA, 23 nt, Homo sapiens
ucaguguugaauuguaccauuuc

SEQ ID NO: 9800 - RNA, 23 nt, Homo sapiens
caguguugaauuguaccauuuca

SEQ ID NO: 9801 - RNA, 23 nt, Homo sapiens
aguguugaauuguaccauuucau

SEQ ID NO: 9802 - RNA, 23 nt, Homo sapiens
guguugaauuguaccauuucauu

SEQ ID NO: 9803 - RNA, 23 nt, Homo sapiens
uguugaauuguaccauuucauua

SEQ ID NO: 9804 - RNA, 23 nt, Homo sapiens
guugaauuguaccauuucauuau

SEQ ID NO: 9805 - RNA, 23 nt, Homo sapiens
uugaauuguaccauuucauuauu

SEQ ID NO: 9806 - RNA, 23 nt, Homo sapiens
ugaauuguaccauuucauuauuu

SEQ ID NO: 9807 - RNA, 23 nt, Homo sapiens
gaauuguaccauuucauuauuuc

SEQ ID NO: 9808 - RNA, 23 nt, Homo sapiens
aauuguaccauuucauuauuucu

SEQ ID NO: 9809 - RNA, 23 nt, Homo sapiens
auuguaccauuucauuauuucuu

SEQ ID NO: 9810 - RNA, 23 nt, Homo sapiens
uuguaccauuucauuauuucuuu

SEQ ID NO: 9811 - RNA, 23 nt, Homo sapiens
uguaccauuucauuauuucuuuu

SEQ ID NO: 9812 - RNA, 23 nt, Homo sapiens
guaccauuucauuauuucuuuuc

SEQ ID NO: 9813 - RNA, 23 nt, Homo sapiens
uaccauuucauuauuucuuuucc

SEQ ID NO: 9814 - RNA, 23 nt, Homo sapiens
accauuucauuauuucuuuucca

SEQ ID NO: 9815 - RNA, 23 nt, Homo sapiens
ccauuucauuauuucuuuuccag

SEQ ID NO: 9816 - RNA, 23 nt, Homo sapiens
cauuucauuauuucuuuuccaga

SEQ ID NO: 9817 - RNA, 23 nt, Homo sapiens
auuucauuauuucuuuuccagaa

SEQ ID NO: 9818 - RNA, 23 nt, Homo sapiens
uuucauuauuucuuuuccagaaa

SEQ ID NO: 9819 - RNA, 23 nt, Homo sapiens
uucauuauuucuuuuccagaaaa

SEQ ID NO: 9820 - RNA, 23 nt, Homo sapiens
ucauuauuucuuuuccagaaaag

SEQ ID NO: 9821 - RNA, 23 nt, Homo sapiens
cauuauuucuuuuccagaaaagc

SEQ ID NO: 9822 - RNA, 23 nt, Homo sapiens
auuauuucuuuuccagaaaagcu

SEQ ID NO: 9823 - RNA, 23 nt, Homo sapiens
uuauuucuuuuccagaaaagcuu

SEQ ID NO: 9824 - RNA, 23 nt, Homo sapiens
uauuucuuuuccagaaaagcuuu

SEQ ID NO: 9825 - RNA, 23 nt, Homo sapiens
auuucuuuuccagaaaagcuuug

SEQ ID NO: 9826 - RNA, 23 nt, Homo sapiens
uuucuuuuccagaaaagcuuugg

SEQ ID NO: 9827 - RNA, 23 nt, Homo sapiens
uucuuuuccagaaaagcuuuggu

SEQ ID NO: 9828 - RNA, 23 nt, Homo sapiens
ucuuuuccagaaaagcuuuggug

SEQ ID NO: 9829 - RNA, 23 nt, Homo sapiens
cuuuuccagaaaagcuuuggugg

SEQ ID NO: 9830 - RNA, 23 nt, Homo sapiens
uuuuccagaaaagcuuuggugga

SEQ ID NO: 9831 - RNA, 23 nt, Homo sapiens
uuuccagaaaagcuuugguggag

SEQ ID NO: 9832 - RNA, 23 nt, Homo sapiens
uuccagaaaagcuuugguggagg

SEQ ID NO: 9833 - RNA, 23 nt, Homo sapiens
uccagaaaagcuuugguggaggu

SEQ ID NO: 9834 - RNA, 23 nt, Homo sapiens
ccagaaaagcuuugguggaggua

SEQ ID NO: 9835 - RNA, 23 nt, Homo sapiens
cagaaaagcuuugguggagguau

SEQ ID NO: 9836 - RNA, 23 nt, Homo sapiens
agaaaagcuuugguggagguaua

SEQ ID NO: 9837 - RNA, 23 nt, Homo sapiens
gaaaagcuuugguggagguauag

SEQ ID NO: 9838 - RNA, 23 nt, Homo sapiens
aaaagcuuugguggagguauagc

SEQ ID NO: 9839 - RNA, 23 nt, Homo sapiens
aaagcuuugguggagguauagcc

SEQ ID NO: 9840 - RNA, 23 nt, Homo sapiens
aagcuuugguggagguauagccg

SEQ ID NO: 9841 - RNA, 23 nt, Homo sapiens
agcuuugguggagguauagccga

SEQ ID NO: 9842 - RNA, 23 nt, Homo sapiens
gcuuugguggagguauagccgag

SEQ ID NO: 9843 - RNA, 23 nt, Homo sapiens
cuuugguggagguauagccgaga

SEQ ID NO: 9844 - RNA, 23 nt, Homo sapiens
uuugguggagguauagccgagau

SEQ ID NO: 9845 - RNA, 23 nt, Homo sapiens
uugguggagguauagccgagauc

SEQ ID NO: 9846 - RNA, 23 nt, Homo sapiens
ugguggagguauagccgagaucu

SEQ ID NO: 9847 - RNA, 23 nt, Homo sapiens
gguggagguauagccgagaucug

SEQ ID NO: 9848 - RNA, 23 nt, Homo sapiens
guggagguauagccgagaucugg

SEQ ID NO: 9849 - RNA, 23 nt, Homo sapiens
uggagguauagccgagaucuggc

SEQ ID NO: 9850 - RNA, 23 nt, Homo sapiens
ggagguauagccgagaucuggca

SEQ ID NO: 9851 - RNA, 23 nt, Homo sapiens
gagguauagccgagaucuggcau

SEQ ID NO: 9852 - RNA, 23 nt, Homo sapiens
agguauagccgagaucuggcauu

SEQ ID NO: 9853 - RNA, 23 nt, Homo sapiens
gguauagccgagaucuggcauuc

SEQ ID NO: 9854 - RNA, 23 nt, Homo sapiens
guauagccgagaucuggcauucu

SEQ ID NO: 9855 - RNA, 23 nt, Homo sapiens
uauagccgagaucuggcauucua

SEQ ID NO: 9856 - RNA, 23 nt, Homo sapiens
auagccgagaucuggcauucuag

SEQ ID NO: 9857 - RNA, 23 nt, Homo sapiens
uagccgagaucuggcauucuagu

SEQ ID NO: 9858 - RNA, 23 nt, Homo sapiens
agccgagaucuggcauucuaguu

SEQ ID NO: 9859 - RNA, 23 nt, Homo sapiens
gccgagaucuggcauucuaguuu

SEQ ID NO: 9860 - RNA, 23 nt, Homo sapiens
ccgagaucuggcauucuaguuuc

SEQ ID NO: 9861 - RNA, 23 nt, Homo sapiens
cgagaucuggcauucuaguuuca

SEQ ID NO: 9862 - RNA, 23 nt, Homo sapiens
gagaucuggcauucuaguuucac

SEQ ID NO: 9863 - RNA, 23 nt, Homo sapiens
agaucuggcauucuaguuucacu

SEQ ID NO: 9864 - RNA, 23 nt, Homo sapiens
gaucuggcauucuaguuucacug

SEQ ID NO: 9865 - RNA, 23 nt, Homo sapiens
aucuggcauucuaguuucacuga

SEQ ID NO: 9866 - RNA, 23 nt, Homo sapiens
ucuggcauucuaguuucacugaa

SEQ ID NO: 9867 - RNA, 23 nt, Homo sapiens
cuggcauucuaguuucacugaau

SEQ ID NO: 9868 - RNA, 23 nt, Homo sapiens
uggcauucuaguuucacugaauc

SEQ ID NO: 9869 - RNA, 23 nt, Homo sapiens
ggcauucuaguuucacugaaucu

SEQ ID NO: 9870 - RNA, 23 nt, Homo sapiens
gcauucuaguuucacugaaucuc

SEQ ID NO: 9871 - RNA, 23 nt, Homo sapiens
cauucuaguuucacugaaucucc

SEQ ID NO: 9872 - RNA, 23 nt, Homo sapiens
auucuaguuucacugaaucuccc

SEQ ID NO: 9873 - RNA, 23 nt, Homo sapiens
uucuaguuucacugaaucucccu

SEQ ID NO: 9874 - RNA, 23 nt, Homo sapiens
ucuaguuucacugaaucucccuc

SEQ ID NO: 9875 - RNA, 23 nt, Homo sapiens
cuaguuucacugaaucucccucu

SEQ ID NO: 9876 - RNA, 23 nt, Homo sapiens
uaguuucacugaaucucccucua

SEQ ID NO: 9877 - RNA, 23 nt, Homo sapiens
aguuucacugaaucucccucuaa

SEQ ID NO: 9878 - RNA, 23 nt, Homo sapiens
guuucacugaaucucccucuaaa

SEQ ID NO: 9879 - RNA, 23 nt, Homo sapiens
uuucacugaaucucccucuaaaa

SEQ ID NO: 9880 - RNA, 23 nt, Homo sapiens
uucacugaaucucccucuaaaac

SEQ ID NO: 9881 - RNA, 23 nt, Homo sapiens
ucacugaaucucccucuaaaacu

SEQ ID NO: 9882 - RNA, 23 nt, Homo sapiens
cacugaaucucccucuaaaacuu

SEQ ID NO: 9883 - RNA, 23 nt, Homo sapiens
acugaaucucccucuaaaacuuu

SEQ ID NO: 9884 - RNA, 23 nt, Homo sapiens
cugaaucucccucuaaaacuuuu

SEQ ID NO: 9885 - RNA, 23 nt, Homo sapiens
ugaaucucccucuaaaacuuuuu

SEQ ID NO: 9886 - RNA, 23 nt, Homo sapiens
gaaucucccucuaaaacuuuuuu

SEQ ID NO: 9887 - RNA, 23 nt, Homo sapiens
aaucucccucuaaaacuuuuuug

SEQ ID NO: 9888 - RNA, 23 nt, Homo sapiens
aucucccucuaaaacuuuuuugc

SEQ ID NO: 9889 - RNA, 23 nt, Homo sapiens
ucucccucuaaaacuuuuuugcu

SEQ ID NO: 9890 - RNA, 23 nt, Homo sapiens
cucccucuaaaacuuuuuugcuc

SEQ ID NO: 9891 - RNA, 23 nt, Homo sapiens
ucccucuaaaacuuuuuugcucu

SEQ ID NO: 9892 - RNA, 23 nt, Homo sapiens
cccucuaaaacuuuuuugcucug

SEQ ID NO: 9893 - RNA, 23 nt, Homo sapiens
ccucuaaaacuuuuuugcucugu

SEQ ID NO: 9894 - RNA, 23 nt, Homo sapiens
cucuaaaacuuuuuugcucugug

SEQ ID NO: 9895 - RNA, 23 nt, Homo sapiens
ucuaaaacuuuuuugcucugugg

SEQ ID NO: 9896 - RNA, 23 nt, Homo sapiens
cuaaaacuuuuuugcucuguggu

SEQ ID NO: 9897 - RNA, 23 nt, Homo sapiens
uaaaacuuuuuugcucugugguu

SEQ ID NO: 9898 - RNA, 23 nt, Homo sapiens
aaaacuuuuuugcucugugguuu

SEQ ID NO: 9899 - RNA, 23 nt, Homo sapiens
aaacuuuuuugcucugugguuug

SEQ ID NO: 9900 - RNA, 23 nt, Homo sapiens
aacuuuuuugcucugugguuugu

SEQ ID NO: 9901 - RNA, 23 nt, Homo sapiens
acuuuuuugcucugugguuugua

SEQ ID NO: 9902 - RNA, 23 nt, Homo sapiens
cuuuuuugcucugugguuuguag

SEQ ID NO: 9903 - RNA, 23 nt, Homo sapiens
uuuuuugcucugugguuuguaga

SEQ ID NO: 9904 - RNA, 23 nt, Homo sapiens
uuuuugcucugugguuuguagau

SEQ ID NO: 9905 - RNA, 23 nt, Homo sapiens
uuuugcucugugguuuguagaua

SEQ ID NO: 9906 - RNA, 23 nt, Homo sapiens
uuugcucugugguuuguagauaa

SEQ ID NO: 9907 - RNA, 23 nt, Homo sapiens
uugcucugugguuuguagauaaa

SEQ ID NO: 9908 - RNA, 23 nt, Homo sapiens
ugcucugugguuuguagauaaac

SEQ ID NO: 9909 - RNA, 23 nt, Homo sapiens
gcucugugguuuguagauaaaca

SEQ ID NO: 9910 - RNA, 23 nt, Homo sapiens
cucugugguuuguagauaaacau

SEQ ID NO: 9911 - RNA, 23 nt, Homo sapiens
ucugugguuuguagauaaacauu

SEQ ID NO: 9912 - RNA, 23 nt, Homo sapiens
cugugguuuguagauaaacauug

SEQ ID NO: 9913 - RNA, 23 nt, Homo sapiens
ugugguuuguagauaaacauugg

SEQ ID NO: 9914 - RNA, 23 nt, Homo sapiens
gugguuuguagauaaacauuggu

SEQ ID NO: 9915 - RNA, 23 nt, Homo sapiens
ugguuuguagauaaacauuggug

SEQ ID NO: 9916 - RNA, 23 nt, Homo sapiens
gguuuguagauaaacauuggugc

SEQ ID NO: 9917 - RNA, 23 nt, Homo sapiens
guuuguagauaaacauuggugcu

SEQ ID NO: 9918 - RNA, 23 nt, Homo sapiens
uuuguagauaaacauuggugcuc

SEQ ID NO: 9919 - RNA, 23 nt, Homo sapiens
uuguagauaaacauuggugcucu

SEQ ID NO: 9920 - RNA, 23 nt, Homo sapiens
uguagauaaacauuggugcucuu

SEQ ID NO: 9921 - RNA, 23 nt, Homo sapiens
guagauaaacauuggugcucuuu

SEQ ID NO: 9922 - RNA, 23 nt, Homo sapiens
uagauaaacauuggugcucuuuu

SEQ ID NO: 9923 - RNA, 23 nt, Homo sapiens
agauaaacauuggugcucuuuua

SEQ ID NO: 9924 - RNA, 23 nt, Homo sapiens
gauaaacauuggugcucuuuuau

SEQ ID NO: 9925 - RNA, 23 nt, Homo sapiens
auaaacauuggugcucuuuuaug

SEQ ID NO: 9926 - RNA, 23 nt, Homo sapiens
uaaacauuggugcucuuuuaugu

SEQ ID NO: 9927 - RNA, 23 nt, Homo sapiens
aaacauuggugcucuuuuauguu

SEQ ID NO: 9928 - RNA, 23 nt, Homo sapiens
aacauuggugcucuuuuauguuc

SEQ ID NO: 9929 - RNA, 23 nt, Homo sapiens
acauuggugcucuuuuauguucu

SEQ ID NO: 9930 - RNA, 23 nt, Homo sapiens
cauuggugcucuuuuauguucuu

SEQ ID NO: 9931 - RNA, 23 nt, Homo sapiens
auuggugcucuuuuauguucuuu

SEQ ID NO: 9932 - RNA, 23 nt, Homo sapiens
uuggugcucuuuuauguucuuuu

SEQ ID NO: 9933 - RNA, 23 nt, Homo sapiens
uggugcucuuuuauguucuuuug

SEQ ID NO: 9934 - RNA, 23 nt, Homo sapiens
ggugcucuuuuauguucuuuugc

SEQ ID NO: 9935 - RNA, 23 nt, Homo sapiens
gugcucuuuuauguucuuuugca

SEQ ID NO: 9936 - RNA, 23 nt, Homo sapiens
ugcucuuuuauguucuuuugcaa

SEQ ID NO: 9937 - RNA, 23 nt, Homo sapiens
gcucuuuuauguucuuuugcaag

SEQ ID NO: 9938 - RNA, 23 nt, Homo sapiens
cucuuuuauguucuuuugcaagg

SEQ ID NO: 9939 - RNA, 23 nt, Homo sapiens
ucuuuuauguucuuuugcaagga

SEQ ID NO: 9940 - RNA, 23 nt, Homo sapiens
cuuuuauguucuuuugcaaggac

SEQ ID NO: 9941 - RNA, 23 nt, Homo sapiens
uuuuauguucuuuugcaaggaca

SEQ ID NO: 9942 - RNA, 23 nt, Homo sapiens
uuuauguucuuuugcaaggacau

SEQ ID NO: 9943 - RNA, 23 nt, Homo sapiens
uuauguucuuuugcaaggacauc

SEQ ID NO: 9944 - RNA, 23 nt, Homo sapiens
uauguucuuuugcaaggacaucc

SEQ ID NO: 9945 - RNA, 23 nt, Homo sapiens
auguucuuuugcaaggacaucca

SEQ ID NO: 9946 - RNA, 23 nt, Homo sapiens
uguucuuuugcaaggacauccag

SEQ ID NO: 9947 - RNA, 23 nt, Homo sapiens
guucuuuugcaaggacauccagc

SEQ ID NO: 9948 - RNA, 23 nt, Homo sapiens
uucuuuugcaaggacauccagcu

SEQ ID NO: 9949 - RNA, 23 nt, Homo sapiens
ucuuuugcaaggacauccagcug

SEQ ID NO: 9950 - RNA, 23 nt, Homo sapiens
cuuuugcaaggacauccagcugc

SEQ ID NO: 9951 - RNA, 23 nt, Homo sapiens
uuuugcaaggacauccagcugca

SEQ ID NO: 9952 - RNA, 23 nt, Homo sapiens
uuugcaaggacauccagcugcac

SEQ ID NO: 9953 - RNA, 23 nt, Homo sapiens
uugcaaggacauccagcugcaca

SEQ ID NO: 9954 - RNA, 23 nt, Homo sapiens
ugcaaggacauccagcugcacag

SEQ ID NO: 9955 - RNA, 23 nt, Homo sapiens
gcaaggacauccagcugcacagu

SEQ ID NO: 9956 - RNA, 23 nt, Homo sapiens
caaggacauccagcugcacagug

SEQ ID NO: 9957 - RNA, 23 nt, Homo sapiens
aaggacauccagcugcacaguga

SEQ ID NO: 9958 - RNA, 23 nt, Homo sapiens
aggacauccagcugcacagugaa

SEQ ID NO: 9959 - RNA, 23 nt, Homo sapiens
ggacauccagcugcacagugaag

SEQ ID NO: 9960 - RNA, 23 nt, Homo sapiens
gacauccagcugcacagugaagg

SEQ ID NO: 9961 - RNA, 23 nt, Homo sapiens
acauccagcugcacagugaaggu

SEQ ID NO: 9962 - RNA, 23 nt, Homo sapiens
cauccagcugcacagugaaggug

SEQ ID NO: 9963 - RNA, 23 nt, Homo sapiens
auccagcugcacagugaaggugg

SEQ ID NO: 9964 - RNA, 23 nt, Homo sapiens
uccagcugcacagugaagguggc

SEQ ID NO: 9965 - RNA, 23 nt, Homo sapiens
ccagcugcacagugaagguggcu

SEQ ID NO: 9966 - RNA, 23 nt, Homo sapiens
cagcugcacagugaagguggcuu

SEQ ID NO: 9967 - RNA, 23 nt, Homo sapiens
agcugcacagugaagguggcuuc

SEQ ID NO: 9968 - RNA, 23 nt, Homo sapiens
gcugcacagugaagguggcuucu

SEQ ID NO: 9969 - RNA, 23 nt, Homo sapiens
cugcacagugaagguggcuucuc

SEQ ID NO: 9970 - RNA, 23 nt, Homo sapiens
ugcacagugaagguggcuucucc

SEQ ID NO: 9971 - RNA, 23 nt, Homo sapiens
gcacagugaagguggcuucuccu

SEQ ID NO: 9972 - RNA, 23 nt, Homo sapiens
cacagugaagguggcuucuccug

SEQ ID NO: 9973 - RNA, 23 nt, Homo sapiens
acagugaagguggcuucuccugc

SEQ ID NO: 9974 - RNA, 23 nt, Homo sapiens
cagugaagguggcuucuccugcu

SEQ ID NO: 9975 - RNA, 23 nt, Homo sapiens
agugaagguggcuucuccugcuc

SEQ ID NO: 9976 - RNA, 23 nt, Homo sapiens
gugaagguggcuucuccugcucu

SEQ ID NO: 9977 - RNA, 23 nt, Homo sapiens
ugaagguggcuucuccugcucua

SEQ ID NO: 9978 - RNA, 23 nt, Homo sapiens
gaagguggcuucuccugcucuau

SEQ ID NO: 9979 - RNA, 23 nt, Homo sapiens
aagguggcuucuccugcucuauu

SEQ ID NO: 9980 - RNA, 23 nt, Homo sapiens
agguggcuucuccugcucuauuc

SEQ ID NO: 9981 - RNA, 23 nt, Homo sapiens
gguggcuucuccugcucuauucu

SEQ ID NO: 9982 - RNA, 23 nt, Homo sapiens
guggcuucuccugcucuauucuu

SEQ ID NO: 9983 - RNA, 23 nt, Homo sapiens
uggcuucuccugcucuauucuug

SEQ ID NO: 9984 - RNA, 23 nt, Homo sapiens
ggcuucuccugcucuauucuugg

SEQ ID NO: 9985 - RNA, 23 nt, Homo sapiens
gcuucuccugcucuauucuuggc

SEQ ID NO: 9986 - RNA, 23 nt, Homo sapiens
cuucuccugcucuauucuuggca

SEQ ID NO: 9987 - RNA, 23 nt, Homo sapiens
uucuccugcucuauucuuggcaa

SEQ ID NO: 9988 - RNA, 23 nt, Homo sapiens
ucuccugcucuauucuuggcaac

SEQ ID NO: 9989 - RNA, 23 nt, Homo sapiens
cuccugcucuauucuuggcaaca

SEQ ID NO: 9990 - RNA, 23 nt, Homo sapiens
uccugcucuauucuuggcaacac

SEQ ID NO: 9991 - RNA, 23 nt, Homo sapiens
ccugcucuauucuuggcaacaca

SEQ ID NO: 9992 - RNA, 23 nt, Homo sapiens
cugcucuauucuuggcaacacau

SEQ ID NO: 9993 - RNA, 23 nt, Homo sapiens
ugcucuauucuuggcaacacaug

SEQ ID NO: 9994 - RNA, 23 nt, Homo sapiens
gcucuauucuuggcaacacaugc

SEQ ID NO: 9995 - RNA, 23 nt, Homo sapiens
cucuauucuuggcaacacaugca

SEQ ID NO: 9996 - RNA, 23 nt, Homo sapiens
ucuauucuuggcaacacaugcau

SEQ ID NO: 9997 - RNA, 23 nt, Homo sapiens
cuauucuuggcaacacaugcaua

SEQ ID NO: 9998 - RNA, 23 nt, Homo sapiens
uauucuuggcaacacaugcauaa

SEQ ID NO: 9999 - RNA, 23 nt, Homo sapiens
auucuuggcaacacaugcauaag

SEQ ID NO: 10000 - RNA, 23 nt, Homo sapiens
uucuuggcaacacaugcauaagc

SEQ ID NO: 10001 - RNA, 23 nt, Homo sapiens
ucuuggcaacacaugcauaagcc

SEQ ID NO: 10002 - RNA, 23 nt, Homo sapiens
cuuggcaacacaugcauaagccc

SEQ ID NO: 10003 - RNA, 23 nt, Homo sapiens
uuggcaacacaugcauaagcccc

SEQ ID NO: 10004 - RNA, 23 nt, Homo sapiens
uggcaacacaugcauaagccccu

SEQ ID NO: 10005 - RNA, 23 nt, Homo sapiens
ggcaacacaugcauaagccccug

SEQ ID NO: 10006 - RNA, 23 nt, Homo sapiens
gcaacacaugcauaagccccugc

SEQ ID NO: 10007 - RNA, 23 nt, Homo sapiens
caacacaugcauaagccccugca

SEQ ID NO: 10008 - RNA, 23 nt, Homo sapiens
aacacaugcauaagccccugcau

SEQ ID NO: 10009 - RNA, 23 nt, Homo sapiens
acacaugcauaagccccugcauc

SEQ ID NO: 10010 - RNA, 23 nt, Homo sapiens
cacaugcauaagccccugcaucu

SEQ ID NO: 10011 - RNA, 23 nt, Homo sapiens
acaugcauaagccccugcaucug

SEQ ID NO: 10012 - RNA, 23 nt, Homo sapiens
caugcauaagccccugcaucuga

SEQ ID NO: 10013 - RNA, 23 nt, Homo sapiens
augcauaagccccugcaucugaa

SEQ ID NO: 10014 - RNA, 23 nt, Homo sapiens
ugcauaagccccugcaucugaag

SEQ ID NO: 10015 - RNA, 23 nt, Homo sapiens
gcauaagccccugcaucugaagc

SEQ ID NO: 10016 - RNA, 23 nt, Homo sapiens
cauaagccccugcaucugaagcu

SEQ ID NO: 10017 - RNA, 23 nt, Homo sapiens
auaagccccugcaucugaagcuc

SEQ ID NO: 10018 - RNA, 23 nt, Homo sapiens
uaagccccugcaucugaagcucu

SEQ ID NO: 10019 - RNA, 23 nt, Homo sapiens
aagccccugcaucugaagcucug

SEQ ID NO: 10020 - RNA, 23 nt, Homo sapiens
agccccugcaucugaagcucuga

SEQ ID NO: 10021 - RNA, 23 nt, Homo sapiens
gccccugcaucugaagcucugac

SEQ ID NO: 10022 - RNA, 23 nt, Homo sapiens
ccccugcaucugaagcucugacu

SEQ ID NO: 10023 - RNA, 23 nt, Homo sapiens
cccugcaucugaagcucugacua

SEQ ID NO: 10024 - RNA, 23 nt, Homo sapiens
ccugcaucugaagcucugacuac

SEQ ID NO: 10025 - RNA, 23 nt, Homo sapiens
cugcaucugaagcucugacuacu

SEQ ID NO: 10026 - RNA, 23 nt, Homo sapiens
ugcaucugaagcucugacuacuu

SEQ ID NO: 10027 - RNA, 23 nt, Homo sapiens
gcaucugaagcucugacuacuuc

SEQ ID NO: 10028 - RNA, 23 nt, Homo sapiens
caucugaagcucugacuacuuca

SEQ ID NO: 10029 - RNA, 23 nt, Homo sapiens
aucugaagcucugacuacuucaa

SEQ ID NO: 10030 - RNA, 23 nt, Homo sapiens
ucugaagcucugacuacuucaaa

SEQ ID NO: 10031 - RNA, 23 nt, Homo sapiens
cugaagcucugacuacuucaaag

SEQ ID NO: 10032 - RNA, 23 nt, Homo sapiens
ugaagcucugacuacuucaaaga

SEQ ID NO: 10033 - RNA, 23 nt, Homo sapiens
gaagcucugacuacuucaaagau

SEQ ID NO: 10034 - RNA, 23 nt, Homo sapiens
aagcucugacuacuucaaagaug

SEQ ID NO: 10035 - RNA, 23 nt, Homo sapiens
agcucugacuacuucaaagauga

SEQ ID NO: 10036 - RNA, 23 nt, Homo sapiens
gcucugacuacuucaaagaugag

SEQ ID NO: 10037 - RNA, 23 nt, Homo sapiens
cucugacuacuucaaagaugagu

SEQ ID NO: 10038 - RNA, 23 nt, Homo sapiens
ucugacuacuucaaagaugagug

SEQ ID NO: 10039 - RNA, 23 nt, Homo sapiens
cugacuacuucaaagaugaguga

SEQ ID NO: 10040 - RNA, 23 nt, Homo sapiens
ugacuacuucaaagaugagugaa

SEQ ID NO: 10041 - RNA, 23 nt, Homo sapiens
gacuacuucaaagaugagugaau

SEQ ID NO: 10042 - RNA, 23 nt, Homo sapiens
acuacuucaaagaugagugaaug

SEQ ID NO: 10043 - RNA, 23 nt, Homo sapiens
cuacuucaaagaugagugaauga

SEQ ID NO: 10044 - RNA, 23 nt, Homo sapiens
uacuucaaagaugagugaaugaa

SEQ ID NO: 10045 - RNA, 23 nt, Homo sapiens
acuucaaagaugagugaaugaag

SEQ ID NO: 10046 - RNA, 23 nt, Homo sapiens
cuucaaagaugagugaaugaaga

SEQ ID NO: 10047 - RNA, 23 nt, Homo sapiens
uucaaagaugagugaaugaagac

SEQ ID NO: 10048 - RNA, 23 nt, Homo sapiens
ucaaagaugagugaaugaagacc

SEQ ID NO: 10049 - RNA, 23 nt, Homo sapiens
caaagaugagugaaugaagaccc

SEQ ID NO: 10050 - RNA, 23 nt, Homo sapiens
aaagaugagugaaugaagacccu

SEQ ID NO: 10051 - RNA, 23 nt, Homo sapiens
aagaugagugaaugaagacccuu

SEQ ID NO: 10052 - RNA, 23 nt, Homo sapiens
agaugagugaaugaagacccuuc

SEQ ID NO: 10053 - RNA, 23 nt, Homo sapiens
gaugagugaaugaagacccuucu

SEQ ID NO: 10054 - RNA, 23 nt, Homo sapiens
augagugaaugaagacccuucuc

SEQ ID NO: 10055 - RNA, 23 nt, Homo sapiens
ugagugaaugaagacccuucuca

SEQ ID NO: 10056 - RNA, 23 nt, Homo sapiens
gagugaaugaagacccuucucag

SEQ ID NO: 10057 - RNA, 23 nt, Homo sapiens
agugaaugaagacccuucucaga

SEQ ID NO: 10058 - RNA, 23 nt, Homo sapiens
gugaaugaagacccuucucagac

SEQ ID NO: 10059 - RNA, 23 nt, Homo sapiens
ugaaugaagacccuucucagaca

SEQ ID NO: 10060 - RNA, 23 nt, Homo sapiens
gaaugaagacccuucucagacac

SEQ ID NO: 10061 - RNA, 23 nt, Homo sapiens
aaugaagacccuucucagacacu

SEQ ID NO: 10062 - RNA, 23 nt, Homo sapiens
augaagacccuucucagacacua

SEQ ID NO: 10063 - RNA, 23 nt, Homo sapiens
ugaagacccuucucagacacuau

SEQ ID NO: 10064 - RNA, 23 nt, Homo sapiens
gaagacccuucucagacacuauc

SEQ ID NO: 10065 - RNA, 23 nt, Homo sapiens
aagacccuucucagacacuauca

SEQ ID NO: 10066 - RNA, 23 nt, Homo sapiens
agacccuucucagacacuaucau

SEQ ID NO: 10067 - RNA, 23 nt, Homo sapiens
gacccuucucagacacuaucauu

SEQ ID NO: 10068 - RNA, 23 nt, Homo sapiens
acccuucucagacacuaucauuu

SEQ ID NO: 10069 - RNA, 23 nt, Homo sapiens
cccuucucagacacuaucauuuu

SEQ ID NO: 10070 - RNA, 23 nt, Homo sapiens
ccuucucagacacuaucauuuug

SEQ ID NO: 10071 - RNA, 23 nt, Homo sapiens
cuucucagacacuaucauuuugu

SEQ ID NO: 10072 - RNA, 23 nt, Homo sapiens
uucucagacacuaucauuuugug

SEQ ID NO: 10073 - RNA, 23 nt, Homo sapiens
ucucagacacuaucauuuugugc

SEQ ID NO: 10074 - RNA, 23 nt, Homo sapiens
cucagacacuaucauuuugugca

SEQ ID NO: 10075 - RNA, 23 nt, Homo sapiens
ucagacacuaucauuuugugcaa

SEQ ID NO: 10076 - RNA, 23 nt, Homo sapiens
cagacacuaucauuuugugcaaa

SEQ ID NO: 10077 - RNA, 23 nt, Homo sapiens
agacacuaucauuuugugcaaau

SEQ ID NO: 10078 - RNA, 23 nt, Homo sapiens
gacacuaucauuuugugcaaauc

SEQ ID NO: 10079 - RNA, 23 nt, Homo sapiens
acacuaucauuuugugcaaauca

SEQ ID NO: 10080 - RNA, 23 nt, Homo sapiens
cacuaucauuuugugcaaaucau

SEQ ID NO: 10081 - RNA, 23 nt, Homo sapiens
acuaucauuuugugcaaaucauc

SEQ ID NO: 10082 - RNA, 23 nt, Homo sapiens
cuaucauuuugugcaaaucaucu

SEQ ID NO: 10083 - RNA, 23 nt, Homo sapiens
uaucauuuugugcaaaucaucug

SEQ ID NO: 10084 - RNA, 23 nt, Homo sapiens
aucauuuugugcaaaucaucuga

SEQ ID NO: 10085 - RNA, 23 nt, Homo sapiens
ucauuuugugcaaaucaucugau

SEQ ID NO: 10086 - RNA, 23 nt, Homo sapiens
cauuuugugcaaaucaucugauu

SEQ ID NO: 10087 - RNA, 23 nt, Homo sapiens
auuuugugcaaaucaucugauug

SEQ ID NO: 10088 - RNA, 23 nt, Homo sapiens
uuuugugcaaaucaucugauuga

SEQ ID NO: 10089 - RNA, 23 nt, Homo sapiens
uuugugcaaaucaucugauugaa

SEQ ID NO: 10090 - RNA, 23 nt, Homo sapiens
uugugcaaaucaucugauugaac

SEQ ID NO: 10091 - RNA, 23 nt, Homo sapiens
ugugcaaaucaucugauugaacu

SEQ ID NO: 10092 - RNA, 23 nt, Homo sapiens
gugcaaaucaucugauugaacug

SEQ ID NO: 10093 - RNA, 23 nt, Homo sapiens
ugcaaaucaucugauugaacugu

SEQ ID NO: 10094 - RNA, 23 nt, Homo sapiens
gcaaaucaucugauugaacuguu

SEQ ID NO: 10095 - RNA, 23 nt, Homo sapiens
caaaucaucugauugaacuguuc

SEQ ID NO: 10096 - RNA, 23 nt, Homo sapiens
aaaucaucugauugaacuguucu

SEQ ID NO: 10097 - RNA, 23 nt, Homo sapiens
aaucaucugauugaacuguucuu

SEQ ID NO: 10098 - RNA, 23 nt, Homo sapiens
aucaucugauugaacuguucuuc

SEQ ID NO: 10099 - RNA, 23 nt, Homo sapiens
ucaucugauugaacuguucuucc

SEQ ID NO: 10100 - RNA, 23 nt, Homo sapiens
caucugauugaacuguucuucca

SEQ ID NO: 10101 - RNA, 23 nt, Homo sapiens
aucugauugaacuguucuuccau

SEQ ID NO: 10102 - RNA, 23 nt, Homo sapiens
ucugauugaacuguucuuccauu

SEQ ID NO: 10103 - RNA, 23 nt, Homo sapiens
cugauugaacuguucuuccauuu

SEQ ID NO: 10104 - RNA, 23 nt, Homo sapiens
ugauugaacuguucuuccauuua

SEQ ID NO: 10105 - RNA, 23 nt, Homo sapiens
gauugaacuguucuuccauuuag

SEQ ID NO: 10106 - RNA, 23 nt, Homo sapiens
auugaacuguucuuccauuuaga

SEQ ID NO: 10107 - RNA, 23 nt, Homo sapiens
uugaacuguucuuccauuuagau

SEQ ID NO: 10108 - RNA, 23 nt, Homo sapiens
ugaacuguucuuccauuuagaua

SEQ ID NO: 10109 - RNA, 23 nt, Homo sapiens
gaacuguucuuccauuuagauac

SEQ ID NO: 10110 - RNA, 23 nt, Homo sapiens
aacuguucuuccauuuagauacc

SEQ ID NO: 10111 - RNA, 23 nt, Homo sapiens
acuguucuuccauuuagauacca

SEQ ID NO: 10112 - RNA, 23 nt, Homo sapiens
cuguucuuccauuuagauaccau

SEQ ID NO: 10113 - RNA, 23 nt, Homo sapiens
uguucuuccauuuagauaccaug

SEQ ID NO: 10114 - RNA, 23 nt, Homo sapiens
guucuuccauuuagauaccauga

SEQ ID NO: 10115 - RNA, 23 nt, Homo sapiens
uucuuccauuuagauaccaugac

SEQ ID NO: 10116 - RNA, 23 nt, Homo sapiens
ucuuccauuuagauaccaugaca

SEQ ID NO: 10117 - RNA, 23 nt, Homo sapiens
cuuccauuuagauaccaugacac

SEQ ID NO: 10118 - RNA, 23 nt, Homo sapiens
uuccauuuagauaccaugacaca

SEQ ID NO: 10119 - RNA, 23 nt, Homo sapiens
uccauuuagauaccaugacacau

SEQ ID NO: 10120 - RNA, 23 nt, Homo sapiens
ccauuuagauaccaugacacauc

SEQ ID NO: 10121 - RNA, 23 nt, Homo sapiens
cauuuagauaccaugacacauca

SEQ ID NO: 10122 - RNA, 23 nt, Homo sapiens
auuuagauaccaugacacaucag

SEQ ID NO: 10123 - RNA, 23 nt, Homo sapiens
uuuagauaccaugacacaucagg

SEQ ID NO: 10124 - RNA, 23 nt, Homo sapiens
uuagauaccaugacacaucagga

SEQ ID NO: 10125 - RNA, 23 nt, Homo sapiens
uagauaccaugacacaucaggag

SEQ ID NO: 10126 - RNA, 23 nt, Homo sapiens
agauaccaugacacaucaggagc

SEQ ID NO: 10127 - RNA, 23 nt, Homo sapiens
gauaccaugacacaucaggagcu

SEQ ID NO: 10128 - RNA, 23 nt, Homo sapiens
auaccaugacacaucaggagcug

SEQ ID NO: 10129 - RNA, 23 nt, Homo sapiens
uaccaugacacaucaggagcugg

SEQ ID NO: 10130 - RNA, 23 nt, Homo sapiens
accaugacacaucaggagcuggc

SEQ ID NO: 10131 - RNA, 23 nt, Homo sapiens
ccaugacacaucaggagcuggca

SEQ ID NO: 10132 - RNA, 23 nt, Homo sapiens
caugacacaucaggagcuggcag

SEQ ID NO: 10133 - RNA, 23 nt, Homo sapiens
augacacaucaggagcuggcagu

SEQ ID NO: 10134 - RNA, 23 nt, Homo sapiens
ugacacaucaggagcuggcaguc

SEQ ID NO: 10135 - RNA, 23 nt, Homo sapiens
gacacaucaggagcuggcagucc

SEQ ID NO: 10136 - RNA, 23 nt, Homo sapiens
acacaucaggagcuggcagucca

SEQ ID NO: 10137 - RNA, 23 nt, Homo sapiens
cacaucaggagcuggcaguccac

SEQ ID NO: 10138 - RNA, 23 nt, Homo sapiens
acaucaggagcuggcaguccacu

SEQ ID NO: 10139 - RNA, 23 nt, Homo sapiens
caucaggagcuggcaguccacuc

SEQ ID NO: 10140 - RNA, 23 nt, Homo sapiens
aucaggagcuggcaguccacuca

SEQ ID NO: 10141 - RNA, 23 nt, Homo sapiens
ucaggagcuggcaguccacucac

SEQ ID NO: 10142 - RNA, 23 nt, Homo sapiens
caggagcuggcaguccacucacu

SEQ ID NO: 10143 - RNA, 23 nt, Homo sapiens
aggagcuggcaguccacucacuu

SEQ ID NO: 10144 - RNA, 23 nt, Homo sapiens
ggagcuggcaguccacucacuuu

SEQ ID NO: 10145 - RNA, 23 nt, Homo sapiens
gagcuggcaguccacucacuuug

SEQ ID NO: 10146 - RNA, 23 nt, Homo sapiens
agcuggcaguccacucacuuuga

SEQ ID NO: 10147 - RNA, 23 nt, Homo sapiens
gcuggcaguccacucacuuugaa

SEQ ID NO: 10148 - RNA, 23 nt, Homo sapiens
cuggcaguccacucacuuugaag

SEQ ID NO: 10149 - RNA, 23 nt, Homo sapiens
uggcaguccacucacuuugaagu

SEQ ID NO: 10150 - RNA, 23 nt, Homo sapiens
ggcaguccacucacuuugaaguc

SEQ ID NO: 10151 - RNA, 23 nt, Homo sapiens
gcaguccacucacuuugaagucc

SEQ ID NO: 10152 - RNA, 23 nt, Homo sapiens
caguccacucacuuugaagucca

SEQ ID NO: 10153 - RNA, 23 nt, Homo sapiens
aguccacucacuuugaaguccau

SEQ ID NO: 10154 - RNA, 23 nt, Homo sapiens
guccacucacuuugaaguccauu

SEQ ID NO: 10155 - RNA, 23 nt, Homo sapiens
uccacucacuuugaaguccauuc

SEQ ID NO: 10156 - RNA, 23 nt, Homo sapiens
ccacucacuuugaaguccauucu

SEQ ID NO: 10157 - RNA, 23 nt, Homo sapiens
cacucacuuugaaguccauucug

SEQ ID NO: 10158 - RNA, 23 nt, Homo sapiens
acucacuuugaaguccauucugc

SEQ ID NO: 10159 - RNA, 23 nt, Homo sapiens
cucacuuugaaguccauucugca

SEQ ID NO: 10160 - RNA, 23 nt, Homo sapiens
ucacuuugaaguccauucugcag

SEQ ID NO: 10161 - RNA, 23 nt, Homo sapiens
cacuuugaaguccauucugcaga

SEQ ID NO: 10162 - RNA, 23 nt, Homo sapiens
acuuugaaguccauucugcagaa

SEQ ID NO: 10163 - RNA, 23 nt, Homo sapiens
cuuugaaguccauucugcagaau

SEQ ID NO: 10164 - RNA, 23 nt, Homo sapiens
uuugaaguccauucugcagaauc

SEQ ID NO: 10165 - RNA, 23 nt, Homo sapiens
uugaaguccauucugcagaaucu

SEQ ID NO: 10166 - RNA, 23 nt, Homo sapiens
ugaaguccauucugcagaaucuu

SEQ ID NO: 10167 - RNA, 23 nt, Homo sapiens
gaaguccauucugcagaaucuuc

SEQ ID NO: 10168 - RNA, 23 nt, Homo sapiens
aaguccauucugcagaaucuucc

SEQ ID NO: 10169 - RNA, 23 nt, Homo sapiens
aguccauucugcagaaucuuccu

SEQ ID NO: 10170 - RNA, 23 nt, Homo sapiens
guccauucugcagaaucuuccuu

SEQ ID NO: 10171 - RNA, 23 nt, Homo sapiens
uccauucugcagaaucuuccuuc

SEQ ID NO: 10172 - RNA, 23 nt, Homo sapiens
ccauucugcagaaucuuccuuca

SEQ ID NO: 10173 - RNA, 23 nt, Homo sapiens
cauucugcagaaucuuccuucau

SEQ ID NO: 10174 - RNA, 23 nt, Homo sapiens
auucugcagaaucuuccuucauc

SEQ ID NO: 10175 - RNA, 23 nt, Homo sapiens
uucugcagaaucuuccuucauca

SEQ ID NO: 10176 - RNA, 23 nt, Homo sapiens
ucugcagaaucuuccuucaucaa

SEQ ID NO: 10177 - RNA, 23 nt, Homo sapiens
cugcagaaucuuccuucaucaau

SEQ ID NO: 10178 - RNA, 23 nt, Homo sapiens
ugcagaaucuuccuucaucaauc

SEQ ID NO: 10179 - RNA, 23 nt, Homo sapiens
gcagaaucuuccuucaucaaucg

SEQ ID NO: 10180 - RNA, 23 nt, Homo sapiens
cagaaucuuccuucaucaaucga

SEQ ID NO: 10181 - RNA, 23 nt, Homo sapiens
agaaucuuccuucaucaaucgac

SEQ ID NO: 10182 - RNA, 23 nt, Homo sapiens
gaaucuuccuucaucaaucgaca

SEQ ID NO: 10183 - RNA, 23 nt, Homo sapiens
aaucuuccuucaucaaucgacau

SEQ ID NO: 10184 - RNA, 23 nt, Homo sapiens
aucuuccuucaucaaucgacaug

SEQ ID NO: 10185 - RNA, 23 nt, Homo sapiens
ucuuccuucaucaaucgacaugu

SEQ ID NO: 10186 - RNA, 23 nt, Homo sapiens
cuuccuucaucaaucgacauguu

SEQ ID NO: 10187 - RNA, 23 nt, Homo sapiens
uuccuucaucaaucgacauguuc

SEQ ID NO: 10188 - RNA, 23 nt, Homo sapiens
uccuucaucaaucgacauguucu

SEQ ID NO: 10189 - RNA, 23 nt, Homo sapiens
ccuucaucaaucgacauguucuc

SEQ ID NO: 10190 - RNA, 23 nt, Homo sapiens
cuucaucaaucgacauguucucu

SEQ ID NO: 10191 - RNA, 23 nt, Homo sapiens
uucaucaaucgacauguucucug

SEQ ID NO: 10192 - RNA, 23 nt, Homo sapiens
ucaucaaucgacauguucucugg

SEQ ID NO: 10193 - RNA, 23 nt, Homo sapiens
caucaaucgacauguucucuggc

SEQ ID NO: 10194 - RNA, 23 nt, Homo sapiens
aucaaucgacauguucucuggca

SEQ ID NO: 10195 - RNA, 23 nt, Homo sapiens
ucaaucgacauguucucuggcac

SEQ ID NO: 10196 - RNA, 23 nt, Homo sapiens
caaucgacauguucucuggcacu

SEQ ID NO: 10197 - RNA, 23 nt, Homo sapiens
aaucgacauguucucuggcacuu

SEQ ID NO: 10198 - RNA, 23 nt, Homo sapiens
aucgacauguucucuggcacuug

SEQ ID NO: 10199 - RNA, 23 nt, Homo sapiens
ucgacauguucucuggcacuuga

SEQ ID NO: 10200 - RNA, 23 nt, Homo sapiens
cgacauguucucuggcacuugaa

SEQ ID NO: 10201 - RNA, 23 nt, Homo sapiens
gacauguucucuggcacuugaau

SEQ ID NO: 10202 - RNA, 23 nt, Homo sapiens
acauguucucuggcacuugaaug

SEQ ID NO: 10203 - RNA, 23 nt, Homo sapiens
cauguucucuggcacuugaauga

SEQ ID NO: 10204 - RNA, 23 nt, Homo sapiens
auguucucuggcacuugaaugaa

SEQ ID NO: 10205 - RNA, 23 nt, Homo sapiens
uguucucuggcacuugaaugaaa

SEQ ID NO: 10206 - RNA, 23 nt, Homo sapiens
guucucuggcacuugaaugaaac

SEQ ID NO: 10207 - RNA, 23 nt, Homo sapiens
uucucuggcacuugaaugaaacg

SEQ ID NO: 10208 - RNA, 23 nt, Homo sapiens
ucucuggcacuugaaugaaacgu

SEQ ID NO: 10209 - RNA, 23 nt, Homo sapiens
cucuggcacuugaaugaaacgug

SEQ ID NO: 10210 - RNA, 23 nt, Homo sapiens
ucuggcacuugaaugaaacgugg

SEQ ID NO: 10211 - RNA, 23 nt, Homo sapiens
cuggcacuugaaugaaacguggu

SEQ ID NO: 10212 - RNA, 23 nt, Homo sapiens
uggcacuugaaugaaacguggug

SEQ ID NO: 10213 - RNA, 23 nt, Homo sapiens
ggcacuugaaugaaacguggugg

SEQ ID NO: 10214 - RNA, 23 nt, Homo sapiens
gcacuugaaugaaacgugguggg

SEQ ID NO: 10215 - RNA, 23 nt, Homo sapiens
cacuugaaugaaacguggugggu

SEQ ID NO: 10216 - RNA, 23 nt, Homo sapiens
acuugaaugaaacguggugggua

SEQ ID NO: 10217 - RNA, 23 nt, Homo sapiens
cuugaaugaaacgugguggguaa

SEQ ID NO: 10218 - RNA, 23 nt, Homo sapiens
uugaaugaaacgugguggguaaa

SEQ ID NO: 10219 - RNA, 23 nt, Homo sapiens
ugaaugaaacgugguggguaaaa

SEQ ID NO: 10220 - RNA, 23 nt, Homo sapiens
gaaugaaacgugguggguaaaau

SEQ ID NO: 10221 - RNA, 23 nt, Homo sapiens
aaugaaacgugguggguaaaauu

SEQ ID NO: 10222 - RNA, 23 nt, Homo sapiens
augaaacgugguggguaaaauuu

SEQ ID NO: 10223 - RNA, 23 nt, Homo sapiens
ugaaacgugguggguaaaauuuc

SEQ ID NO: 10224 - RNA, 23 nt, Homo sapiens
gaaacgugguggguaaaauuucu

SEQ ID NO: 10225 - RNA, 23 nt, Homo sapiens
aaacgugguggguaaaauuucuc

SEQ ID NO: 10226 - RNA, 23 nt, Homo sapiens
aacgugguggguaaaauuucucc

SEQ ID NO: 10227 - RNA, 23 nt, Homo sapiens
acgugguggguaaaauuucuccu

SEQ ID NO: 10228 - RNA, 23 nt, Homo sapiens
cgugguggguaaaauuucuccug

SEQ ID NO: 10229 - RNA, 23 nt, Homo sapiens
gugguggguaaaauuucuccugg

SEQ ID NO: 10230 - RNA, 23 nt, Homo sapiens
ugguggguaaaauuucuccugga

SEQ ID NO: 10231 - RNA, 23 nt, Homo sapiens
gguggguaaaauuucuccuggau

SEQ ID NO: 10232 - RNA, 23 nt, Homo sapiens
guggguaaaauuucuccuggauu

SEQ ID NO: 10233 - RNA, 23 nt, Homo sapiens
uggguaaaauuucuccuggauug

SEQ ID NO: 10234 - RNA, 23 nt, Homo sapiens
ggguaaaauuucuccuggauugc

SEQ ID NO: 10235 - RNA, 23 nt, Homo sapiens
gguaaaauuucuccuggauugca

SEQ ID NO: 10236 - RNA, 23 nt, Homo sapiens
guaaaauuucuccuggauugcau

SEQ ID NO: 10237 - RNA, 23 nt, Homo sapiens
uaaaauuucuccuggauugcauc

SEQ ID NO: 10238 - RNA, 23 nt, Homo sapiens
aaaauuucuccuggauugcaucc

SEQ ID NO: 10239 - RNA, 23 nt, Homo sapiens
aaauuucuccuggauugcauccu

SEQ ID NO: 10240 - RNA, 23 nt, Homo sapiens
aauuucuccuggauugcauccug

SEQ ID NO: 10241 - RNA, 23 nt, Homo sapiens
auuucuccuggauugcauccuga

SEQ ID NO: 10242 - RNA, 23 nt, Homo sapiens
uuucuccuggauugcauccugau

SEQ ID NO: 10243 - RNA, 23 nt, Homo sapiens
uucuccuggauugcauccugauc

SEQ ID NO: 10244 - RNA, 23 nt, Homo sapiens
ucuccuggauugcauccugauca

SEQ ID NO: 10245 - RNA, 23 nt, Homo sapiens
cuccuggauugcauccugaucau

SEQ ID NO: 10246 - RNA, 23 nt, Homo sapiens
uccuggauugcauccugaucauu

SEQ ID NO: 10247 - RNA, 23 nt, Homo sapiens
ccuggauugcauccugaucauuc

SEQ ID NO: 10248 - RNA, 23 nt, Homo sapiens
cuggauugcauccugaucauuca

SEQ ID NO: 10249 - RNA, 23 nt, Homo sapiens
uggauugcauccugaucauucac

SEQ ID NO: 10250 - RNA, 23 nt, Homo sapiens
ggauugcauccugaucauucaca

SEQ ID NO: 10251 - RNA, 23 nt, Homo sapiens
gauugcauccugaucauucacau

SEQ ID NO: 10252 - RNA, 23 nt, Homo sapiens
auugcauccugaucauucacauc

SEQ ID NO: 10253 - RNA, 23 nt, Homo sapiens
uugcauccugaucauucacaucu

SEQ ID NO: 10254 - RNA, 23 nt, Homo sapiens
ugcauccugaucauucacaucuc

SEQ ID NO: 10255 - RNA, 23 nt, Homo sapiens
gcauccugaucauucacaucucc

SEQ ID NO: 10256 - RNA, 23 nt, Homo sapiens
cauccugaucauucacaucuccc

SEQ ID NO: 10257 - RNA, 23 nt, Homo sapiens
auccugaucauucacaucucccc

SEQ ID NO: 10258 - RNA, 23 nt, Homo sapiens
uccugaucauucacaucuccccu

SEQ ID NO: 10259 - RNA, 23 nt, Homo sapiens
ccugaucauucacaucuccccuu

SEQ ID NO: 10260 - RNA, 23 nt, Homo sapiens
cugaucauucacaucuccccuug

SEQ ID NO: 10261 - RNA, 23 nt, Homo sapiens
ugaucauucacaucuccccuuga

SEQ ID NO: 10262 - RNA, 23 nt, Homo sapiens
gaucauucacaucuccccuugag

SEQ ID NO: 10263 - RNA, 23 nt, Homo sapiens
aucauucacaucuccccuugagg

SEQ ID NO: 10264 - RNA, 23 nt, Homo sapiens
ucauucacaucuccccuugaggu

SEQ ID NO: 10265 - RNA, 23 nt, Homo sapiens
cauucacaucuccccuugagguu

SEQ ID NO: 10266 - RNA, 23 nt, Homo sapiens
auucacaucuccccuugagguug

SEQ ID NO: 10267 - RNA, 23 nt, Homo sapiens
uucacaucuccccuugagguuga

SEQ ID NO: 10268 - RNA, 23 nt, Homo sapiens
ucacaucuccccuugagguugau

SEQ ID NO: 10269 - RNA, 23 nt, Homo sapiens
cacaucuccccuugagguugauc

SEQ ID NO: 10270 - RNA, 23 nt, Homo sapiens
acaucuccccuugagguugaucu

SEQ ID NO: 10271 - RNA, 23 nt, Homo sapiens
caucuccccuugagguugaucua

SEQ ID NO: 10272 - RNA, 23 nt, Homo sapiens
aucuccccuugagguugaucuac

SEQ ID NO: 10273 - RNA, 23 nt, Homo sapiens
ucuccccuugagguugaucuacu

SEQ ID NO: 10274 - RNA, 23 nt, Homo sapiens
cuccccuugagguugaucuacuu

SEQ ID NO: 10275 - RNA, 23 nt, Homo sapiens
uccccuugagguugaucuacuuc

SEQ ID NO: 10276 - RNA, 23 nt, Homo sapiens
ccccuugagguugaucuacuucu

SEQ ID NO: 10277 - RNA, 23 nt, Homo sapiens
cccuugagguugaucuacuucuu

SEQ ID NO: 10278 - RNA, 23 nt, Homo sapiens
ccuugagguugaucuacuucuua

SEQ ID NO: 10279 - RNA, 23 nt, Homo sapiens
cuugagguugaucuacuucuuac

SEQ ID NO: 10280 - RNA, 23 nt, Homo sapiens
uugagguugaucuacuucuuacu

SEQ ID NO: 10281 - RNA, 23 nt, Homo sapiens
ugagguugaucuacuucuuacuu

SEQ ID NO: 10282 - RNA, 23 nt, Homo sapiens
gagguugaucuacuucuuacuug

SEQ ID NO: 10283 - RNA, 23 nt, Homo sapiens
agguugaucuacuucuuacuugu

SEQ ID NO: 10284 - RNA, 23 nt, Homo sapiens
gguugaucuacuucuuacuugug

SEQ ID NO: 10285 - RNA, 23 nt, Homo sapiens
guugaucuacuucuuacuuguga

SEQ ID NO: 10286 - RNA, 23 nt, Homo sapiens
uugaucuacuucuuacuugugau

SEQ ID NO: 10287 - RNA, 23 nt, Homo sapiens
ugaucuacuucuuacuugugaug

SEQ ID NO: 10288 - RNA, 23 nt, Homo sapiens
gaucuacuucuuacuugugaugu

SEQ ID NO: 10289 - RNA, 23 nt, Homo sapiens
aucuacuucuuacuugugaugua

SEQ ID NO: 10290 - RNA, 23 nt, Homo sapiens
ucuacuucuuacuugugauguag

SEQ ID NO: 10291 - RNA, 23 nt, Homo sapiens
cuacuucuuacuugugauguagg

SEQ ID NO: 10292 - RNA, 23 nt, Homo sapiens
uacuucuuacuugugauguagga

SEQ ID NO: 10293 - RNA, 23 nt, Homo sapiens
acuucuuacuugugauguaggaa

SEQ ID NO: 10294 - RNA, 23 nt, Homo sapiens
cuucuuacuugugauguaggaac

SEQ ID NO: 10295 - RNA, 23 nt, Homo sapiens
uucuuacuugugauguaggaacu

SEQ ID NO: 10296 - RNA, 23 nt, Homo sapiens
ucuuacuugugauguaggaacuu

SEQ ID NO: 10297 - RNA, 23 nt, Homo sapiens
cuuacuugugauguaggaacuug

SEQ ID NO: 10298 - RNA, 23 nt, Homo sapiens
uuacuugugauguaggaacuugc

SEQ ID NO: 10299 - RNA, 23 nt, Homo sapiens
uacuugugauguaggaacuugca

SEQ ID NO: 10300 - RNA, 23 nt, Homo sapiens
acuugugauguaggaacuugcag

SEQ ID NO: 10301 - RNA, 23 nt, Homo sapiens
cuugugauguaggaacuugcagu

SEQ ID NO: 10302 - RNA, 23 nt, Homo sapiens
uugugauguaggaacuugcaguc

SEQ ID NO: 10303 - RNA, 23 nt, Homo sapiens
ugugauguaggaacuugcagucg

SEQ ID NO: 10304 - RNA, 23 nt, Homo sapiens
gugauguaggaacuugcagucgc

SEQ ID NO: 10305 - RNA, 23 nt, Homo sapiens
ugauguaggaacuugcagucgcg

SEQ ID NO: 10306 - RNA, 23 nt, Homo sapiens
gauguaggaacuugcagucgcgc

SEQ ID NO: 10307 - RNA, 23 nt, Homo sapiens
auguaggaacuugcagucgcgca

SEQ ID NO: 10308 - RNA, 23 nt, Homo sapiens
uguaggaacuugcagucgcgcau

SEQ ID NO: 10309 - RNA, 23 nt, Homo sapiens
guaggaacuugcagucgcgcaug

SEQ ID NO: 10310 - RNA, 23 nt, Homo sapiens
uaggaacuugcagucgcgcaugu

SEQ ID NO: 10311 - RNA, 23 nt, Homo sapiens
aggaacuugcagucgcgcauguu

SEQ ID NO: 10312 - RNA, 23 nt, Homo sapiens
ggaacuugcagucgcgcauguuc

SEQ ID NO: 10313 - RNA, 23 nt, Homo sapiens
gaacuugcagucgcgcauguucu

SEQ ID NO: 10314 - RNA, 23 nt, Homo sapiens
aacuugcagucgcgcauguucug

SEQ ID NO: 10315 - RNA, 23 nt, Homo sapiens
acuugcagucgcgcauguucuga

SEQ ID NO: 10316 - RNA, 23 nt, Homo sapiens
cuugcagucgcgcauguucugag

SEQ ID NO: 10317 - RNA, 23 nt, Homo sapiens
uugcagucgcgcauguucugagu

SEQ ID NO: 10318 - RNA, 23 nt, Homo sapiens
ugcagucgcgcauguucugaguu

SEQ ID NO: 10319 - RNA, 23 nt, Homo sapiens
gcagucgcgcauguucugaguug

SEQ ID NO: 10320 - RNA, 23 nt, Homo sapiens
cagucgcgcauguucugaguugu

SEQ ID NO: 10321 - RNA, 23 nt, Homo sapiens
agucgcgcauguucugaguugug

SEQ ID NO: 10322 - RNA, 23 nt, Homo sapiens
gucgcgcauguucugaguugugu

SEQ ID NO: 10323 - RNA, 23 nt, Homo sapiens
ucgcgcauguucugaguuguguu

SEQ ID NO: 10324 - RNA, 23 nt, Homo sapiens
cgcgcauguucugaguuguguug

SEQ ID NO: 10325 - RNA, 23 nt, Homo sapiens
gcgcauguucugaguuguguugc

SEQ ID NO: 10326 - RNA, 23 nt, Homo sapiens
cgcauguucugaguuguguugcu

SEQ ID NO: 10327 - RNA, 23 nt, Homo sapiens
gcauguucugaguuguguugcug

SEQ ID NO: 10328 - RNA, 23 nt, Homo sapiens
cauguucugaguuguguugcugc

SEQ ID NO: 10329 - RNA, 23 nt, Homo sapiens
auguucugaguuguguugcugcg

SEQ ID NO: 10330 - RNA, 23 nt, Homo sapiens
uguucugaguuguguugcugcga

SEQ ID NO: 10331 - RNA, 23 nt, Homo sapiens
guucugaguuguguugcugcgag

SEQ ID NO: 10332 - RNA, 23 nt, Homo sapiens
uucugaguuguguugcugcgagu

SEQ ID NO: 10333 - RNA, 23 nt, Homo sapiens
ucugaguuguguugcugcgaguc

SEQ ID NO: 10334 - RNA, 23 nt, Homo sapiens
cugaguuguguugcugcgagucu

SEQ ID NO: 10335 - RNA, 23 nt, Homo sapiens
ugaguuguguugcugcgagucuu

SEQ ID NO: 10336 - RNA, 23 nt, Homo sapiens
gaguuguguugcugcgagucuug

SEQ ID NO: 10337 - RNA, 23 nt, Homo sapiens
aguuguguugcugcgagucuugu

SEQ ID NO: 10338 - RNA, 23 nt, Homo sapiens
guuguguugcugcgagucuugug

SEQ ID NO: 10339 - RNA, 23 nt, Homo sapiens
uuguguugcugcgagucuugugc

SEQ ID NO: 10340 - RNA, 23 nt, Homo sapiens
uguguugcugcgagucuugugca

SEQ ID NO: 10341 - RNA, 23 nt, Homo sapiens
guguugcugcgagucuugugcac

SEQ ID NO: 10342 - RNA, 23 nt, Homo sapiens
uguugcugcgagucuugugcacc

SEQ ID NO: 10343 - RNA, 23 nt, Homo sapiens
guugcugcgagucuugugcacca

SEQ ID NO: 10344 - RNA, 23 nt, Homo sapiens
uugcugcgagucuugugcaccac

SEQ ID NO: 10345 - RNA, 23 nt, Homo sapiens
ugcugcgagucuugugcaccacu

SEQ ID NO: 10346 - RNA, 23 nt, Homo sapiens
gcugcgagucuugugcaccacug

SEQ ID NO: 10347 - RNA, 23 nt, Homo sapiens
cugcgagucuugugcaccacugu

SEQ ID NO: 10348 - RNA, 23 nt, Homo sapiens
ugcgagucuugugcaccacuguc

SEQ ID NO: 10349 - RNA, 23 nt, Homo sapiens
gcgagucuugugcaccacuguca

SEQ ID NO: 10350 - RNA, 23 nt, Homo sapiens
cgagucuugugcaccacugucau

SEQ ID NO: 10351 - RNA, 23 nt, Homo sapiens
gagucuugugcaccacugucauc

SEQ ID NO: 10352 - RNA, 23 nt, Homo sapiens
agucuugugcaccacugucaucc

SEQ ID NO: 10353 - RNA, 23 nt, Homo sapiens
gucuugugcaccacugucauccu

SEQ ID NO: 10354 - RNA, 23 nt, Homo sapiens
ucuugugcaccacugucauccug

SEQ ID NO: 10355 - RNA, 23 nt, Homo sapiens
cuugugcaccacugucauccuga

SEQ ID NO: 10356 - RNA, 23 nt, Homo sapiens
uugugcaccacugucauccugag

SEQ ID NO: 10357 - RNA, 23 nt, Homo sapiens
ugugcaccacugucauccugagc

SEQ ID NO: 10358 - RNA, 23 nt, Homo sapiens
gugcaccacugucauccugagcu

SEQ ID NO: 10359 - RNA, 23 nt, Homo sapiens
ugcaccacugucauccugagcuu

SEQ ID NO: 10360 - RNA, 23 nt, Homo sapiens
gcaccacugucauccugagcuug

SEQ ID NO: 10361 - RNA, 23 nt, Homo sapiens
caccacugucauccugagcuuga

SEQ ID NO: 10362 - RNA, 23 nt, Homo sapiens
accacugucauccugagcuugaa

SEQ ID NO: 10363 - RNA, 23 nt, Homo sapiens
ccacugucauccugagcuugaaa

SEQ ID NO: 10364 - RNA, 23 nt, Homo sapiens
cacugucauccugagcuugaaac

SEQ ID NO: 10365 - RNA, 23 nt, Homo sapiens
acugucauccugagcuugaaaca

SEQ ID NO: 10366 - RNA, 23 nt, Homo sapiens
cugucauccugagcuugaaacac

SEQ ID NO: 10367 - RNA, 23 nt, Homo sapiens
ugucauccugagcuugaaacaca

SEQ ID NO: 10368 - RNA, 23 nt, Homo sapiens
gucauccugagcuugaaacacag

SEQ ID NO: 10369 - RNA, 23 nt, Homo sapiens
ucauccugagcuugaaacacagc

SEQ ID NO: 10370 - RNA, 23 nt, Homo sapiens
cauccugagcuugaaacacagca

SEQ ID NO: 10371 - RNA, 23 nt, Homo sapiens
auccugagcuugaaacacagcag

SEQ ID NO: 10372 - RNA, 23 nt, Homo sapiens
uccugagcuugaaacacagcagc

SEQ ID NO: 10373 - RNA, 23 nt, Homo sapiens
ccugagcuugaaacacagcagcu

SEQ ID NO: 10374 - RNA, 23 nt, Homo sapiens
cugagcuugaaacacagcagcug

SEQ ID NO: 10375 - RNA, 23 nt, Homo sapiens
ugagcuugaaacacagcagcugc

SEQ ID NO: 10376 - RNA, 23 nt, Homo sapiens
gagcuugaaacacagcagcugca

SEQ ID NO: 10377 - RNA, 23 nt, Homo sapiens
agcuugaaacacagcagcugcau

SEQ ID NO: 10378 - RNA, 23 nt, Homo sapiens
gcuugaaacacagcagcugcauu

SEQ ID NO: 10379 - RNA, 23 nt, Homo sapiens
cuugaaacacagcagcugcauuc

SEQ ID NO: 10380 - RNA, 23 nt, Homo sapiens
uugaaacacagcagcugcauucu

SEQ ID NO: 10381 - RNA, 23 nt, Homo sapiens
ugaaacacagcagcugcauucug

SEQ ID NO: 10382 - RNA, 23 nt, Homo sapiens
gaaacacagcagcugcauucugu

SEQ ID NO: 10383 - RNA, 23 nt, Homo sapiens
aaacacagcagcugcauucugug

SEQ ID NO: 10384 - RNA, 23 nt, Homo sapiens
aacacagcagcugcauucugugg

SEQ ID NO: 10385 - RNA, 23 nt, Homo sapiens
acacagcagcugcauucuguggu

SEQ ID NO: 10386 - RNA, 23 nt, Homo sapiens
cacagcagcugcauucugugguc

SEQ ID NO: 10387 - RNA, 23 nt, Homo sapiens
acagcagcugcauucuguggucc

SEQ ID NO: 10388 - RNA, 23 nt, Homo sapiens
cagcagcugcauucugugguccu

SEQ ID NO: 10389 - RNA, 23 nt, Homo sapiens
agcagcugcauucugugguccua

SEQ ID NO: 10390 - RNA, 23 nt, Homo sapiens
gcagcugcauucugugguccuag

SEQ ID NO: 10391 - RNA, 23 nt, Homo sapiens
cagcugcauucugugguccuagc

SEQ ID NO: 10392 - RNA, 23 nt, Homo sapiens
agcugcauucugugguccuagca

SEQ ID NO: 10393 - RNA, 23 nt, Homo sapiens
gcugcauucugugguccuagcaa

SEQ ID NO: 10394 - RNA, 23 nt, Homo sapiens
cugcauucugugguccuagcaau

SEQ ID NO: 10395 - RNA, 23 nt, Homo sapiens
ugcauucugugguccuagcaauc

SEQ ID NO: 10396 - RNA, 23 nt, Homo sapiens
gcauucugugguccuagcaaucu

SEQ ID NO: 10397 - RNA, 23 nt, Homo sapiens
cauucugugguccuagcaaucug

SEQ ID NO: 10398 - RNA, 23 nt, Homo sapiens
auucugugguccuagcaaucugc

SEQ ID NO: 10399 - RNA, 23 nt, Homo sapiens
uucugugguccuagcaaucugcg

SEQ ID NO: 10400 - RNA, 23 nt, Homo sapiens
ucugugguccuagcaaucugcga

SEQ ID NO: 10401 - RNA, 23 nt, Homo sapiens
cugugguccuagcaaucugcgag

SEQ ID NO: 10402 - RNA, 23 nt, Homo sapiens
ugugguccuagcaaucugcgagc

SEQ ID NO: 10403 - RNA, 23 nt, Homo sapiens
gugguccuagcaaucugcgagcc

SEQ ID NO: 10404 - RNA, 23 nt, Homo sapiens
ugguccuagcaaucugcgagcca

SEQ ID NO: 10405 - RNA, 23 nt, Homo sapiens
gguccuagcaaucugcgagccau

SEQ ID NO: 10406 - RNA, 23 nt, Homo sapiens
guccuagcaaucugcgagccauc

SEQ ID NO: 10407 - RNA, 23 nt, Homo sapiens
uccuagcaaucugcgagccaucu

SEQ ID NO: 10408 - RNA, 23 nt, Homo sapiens
ccuagcaaucugcgagccaucuu

SEQ ID NO: 10409 - RNA, 23 nt, Homo sapiens
cuagcaaucugcgagccaucuuc

SEQ ID NO: 10410 - RNA, 23 nt, Homo sapiens
uagcaaucugcgagccaucuucu

SEQ ID NO: 10411 - RNA, 23 nt, Homo sapiens
agcaaucugcgagccaucuucuc

SEQ ID NO: 10412 - RNA, 23 nt, Homo sapiens
gcaaucugcgagccaucuucucu

SEQ ID NO: 10413 - RNA, 23 nt, Homo sapiens
caaucugcgagccaucuucucuu

SEQ ID NO: 10414 - RNA, 23 nt, Homo sapiens
aaucugcgagccaucuucucuuc

SEQ ID NO: 10415 - RNA, 23 nt, Homo sapiens
aucugcgagccaucuucucuuca

SEQ ID NO: 10416 - RNA, 23 nt, Homo sapiens
ucugcgagccaucuucucuucau

SEQ ID NO: 10417 - RNA, 23 nt, Homo sapiens
cugcgagccaucuucucuucaua

SEQ ID NO: 10418 - RNA, 23 nt, Homo sapiens
ugcgagccaucuucucuucauau

SEQ ID NO: 10419 - RNA, 23 nt, Homo sapiens
gcgagccaucuucucuucauaug

SEQ ID NO: 10420 - RNA, 23 nt, Homo sapiens
cgagccaucuucucuucauaugu

SEQ ID NO: 10421 - RNA, 23 nt, Homo sapiens
gagccaucuucucuucauauguu

SEQ ID NO: 10422 - RNA, 23 nt, Homo sapiens
agccaucuucucuucauauguua

SEQ ID NO: 10423 - RNA, 23 nt, Homo sapiens
gccaucuucucuucauauguuag

SEQ ID NO: 10424 - RNA, 23 nt, Homo sapiens
ccaucuucucuucauauguuaga

SEQ ID NO: 10425 - RNA, 23 nt, Homo sapiens
caucuucucuucauauguuagac

SEQ ID NO: 10426 - RNA, 23 nt, Homo sapiens
aucuucucuucauauguuagacg

SEQ ID NO: 10427 - RNA, 23 nt, Homo sapiens
ucuucucuucauauguuagacgu

SEQ ID NO: 10428 - RNA, 23 nt, Homo sapiens
cuucucuucauauguuagacguu

SEQ ID NO: 10429 - RNA, 23 nt, Homo sapiens
uucucuucauauguuagacguug

SEQ ID NO: 10430 - RNA, 23 nt, Homo sapiens
ucucuucauauguuagacguuga

SEQ ID NO: 10431 - RNA, 23 nt, Homo sapiens
cucuucauauguuagacguugau

SEQ ID NO: 10432 - RNA, 23 nt, Homo sapiens
ucuucauauguuagacguugauu

SEQ ID NO: 10433 - RNA, 23 nt, Homo sapiens
cuucauauguuagacguugauuu

SEQ ID NO: 10434 - RNA, 23 nt, Homo sapiens
uucauauguuagacguugauuuc

SEQ ID NO: 10435 - RNA, 23 nt, Homo sapiens
ucauauguuagacguugauuucc

SEQ ID NO: 10436 - RNA, 23 nt, Homo sapiens
cauauguuagacguugauuucca

SEQ ID NO: 10437 - RNA, 23 nt, Homo sapiens
auauguuagacguugauuuccau

SEQ ID NO: 10438 - RNA, 23 nt, Homo sapiens
uauguuagacguugauuuccauu

SEQ ID NO: 10439 - RNA, 23 nt, Homo sapiens
auguuagacguugauuuccauua

SEQ ID NO: 10440 - RNA, 23 nt, Homo sapiens
uguuagacguugauuuccauuau

SEQ ID NO: 10441 - RNA, 23 nt, Homo sapiens
guuagacguugauuuccauuaug

SEQ ID NO: 10442 - RNA, 23 nt, Homo sapiens
uuagacguugauuuccauuauga

SEQ ID NO: 10443 - RNA, 23 nt, Homo sapiens
uagacguugauuuccauuaugaa

SEQ ID NO: 10444 - RNA, 23 nt, Homo sapiens
agacguugauuuccauuaugaag

SEQ ID NO: 10445 - RNA, 23 nt, Homo sapiens
gacguugauuuccauuaugaaga

SEQ ID NO: 10446 - RNA, 23 nt, Homo sapiens
acguugauuuccauuaugaagaa

SEQ ID NO: 10447 - RNA, 23 nt, Homo sapiens
cguugauuuccauuaugaagaag

SEQ ID NO: 10448 - RNA, 23 nt, Homo sapiens
guugauuuccauuaugaagaagg

SEQ ID NO: 10449 - RNA, 23 nt, Homo sapiens
uugauuuccauuaugaagaaggg

SEQ ID NO: 10450 - RNA, 23 nt, Homo sapiens
ugauuuccauuaugaagaagggu

SEQ ID NO: 10451 - RNA, 23 nt, Homo sapiens
gauuuccauuaugaagaagggug

SEQ ID NO: 10452 - RNA, 23 nt, Homo sapiens
auuuccauuaugaagaagggugu

SEQ ID NO: 10453 - RNA, 23 nt, Homo sapiens
uuuccauuaugaagaaggguguc

SEQ ID NO: 10454 - RNA, 23 nt, Homo sapiens
uuccauuaugaagaagggugucc

SEQ ID NO: 10455 - RNA, 23 nt, Homo sapiens
uccauuaugaagaaggguguccu

SEQ ID NO: 10456 - RNA, 23 nt, Homo sapiens
ccauuaugaagaaggguguccuu

SEQ ID NO: 10457 - RNA, 23 nt, Homo sapiens
cauuaugaagaaggguguccuug

SEQ ID NO: 10458 - RNA, 23 nt, Homo sapiens
auuaugaagaaggguguccuugc

SEQ ID NO: 10459 - RNA, 23 nt, Homo sapiens
uuaugaagaaggguguccuugca

SEQ ID NO: 10460 - RNA, 23 nt, Homo sapiens
uaugaagaaggguguccuugcau

SEQ ID NO: 10461 - RNA, 23 nt, Homo sapiens
augaagaaggguguccuugcauu

SEQ ID NO: 10462 - RNA, 23 nt, Homo sapiens
ugaagaaggguguccuugcauuu

SEQ ID NO: 10463 - RNA, 23 nt, Homo sapiens
gaagaaggguguccuugcauuuc

SEQ ID NO: 10464 - RNA, 23 nt, Homo sapiens
aagaaggguguccuugcauuuca

SEQ ID NO: 10465 - RNA, 23 nt, Homo sapiens
agaaggguguccuugcauuucag

SEQ ID NO: 10466 - RNA, 23 nt, Homo sapiens
gaaggguguccuugcauuucagc

SEQ ID NO: 10467 - RNA, 23 nt, Homo sapiens
aaggguguccuugcauuucagcu

SEQ ID NO: 10468 - RNA, 23 nt, Homo sapiens
aggguguccuugcauuucagcuu

SEQ ID NO: 10469 - RNA, 23 nt, Homo sapiens
ggguguccuugcauuucagcuuu

SEQ ID NO: 10470 - RNA, 23 nt, Homo sapiens
gguguccuugcauuucagcuuuc

SEQ ID NO: 10471 - RNA, 23 nt, Homo sapiens
guguccuugcauuucagcuuucu

SEQ ID NO: 10472 - RNA, 23 nt, Homo sapiens
uguccuugcauuucagcuuucuu

SEQ ID NO: 10473 - RNA, 23 nt, Homo sapiens
guccuugcauuucagcuuucuuu

SEQ ID NO: 10474 - RNA, 23 nt, Homo sapiens
uccuugcauuucagcuuucuuuc

SEQ ID NO: 10475 - RNA, 23 nt, Homo sapiens
ccuugcauuucagcuuucuuucc

SEQ ID NO: 10476 - RNA, 23 nt, Homo sapiens
cuugcauuucagcuuucuuucca

SEQ ID NO: 10477 - RNA, 23 nt, Homo sapiens
uugcauuucagcuuucuuuccaa

SEQ ID NO: 10478 - RNA, 23 nt, Homo sapiens
ugcauuucagcuuucuuuccaaa

SEQ ID NO: 10479 - RNA, 23 nt, Homo sapiens
gcauuucagcuuucuuuccaaau

SEQ ID NO: 10480 - RNA, 23 nt, Homo sapiens
cauuucagcuuucuuuccaaauc

SEQ ID NO: 10481 - RNA, 23 nt, Homo sapiens
auuucagcuuucuuuccaaaucu

SEQ ID NO: 10482 - RNA, 23 nt, Homo sapiens
uuucagcuuucuuuccaaaucuu

SEQ ID NO: 10483 - RNA, 23 nt, Homo sapiens
uucagcuuucuuuccaaaucuug

SEQ ID NO: 10484 - RNA, 23 nt, Homo sapiens
ucagcuuucuuuccaaaucuuga

SEQ ID NO: 10485 - RNA, 23 nt, Homo sapiens
cagcuuucuuuccaaaucuugaa

SEQ ID NO: 10486 - RNA, 23 nt, Homo sapiens
agcuuucuuuccaaaucuugaau

SEQ ID NO: 10487 - RNA, 23 nt, Homo sapiens
gcuuucuuuccaaaucuugaauc

SEQ ID NO: 10488 - RNA, 23 nt, Homo sapiens
cuuucuuuccaaaucuugaauca

SEQ ID NO: 10489 - RNA, 23 nt, Homo sapiens
uuucuuuccaaaucuugaaucaa

SEQ ID NO: 10490 - RNA, 23 nt, Homo sapiens
uucuuuccaaaucuugaaucaaa

SEQ ID NO: 10491 - RNA, 23 nt, Homo sapiens
ucuuuccaaaucuugaaucaaag

SEQ ID NO: 10492 - RNA, 23 nt, Homo sapiens
cuuuccaaaucuugaaucaaagc

SEQ ID NO: 10493 - RNA, 23 nt, Homo sapiens
uuuccaaaucuugaaucaaagcu

SEQ ID NO: 10494 - RNA, 23 nt, Homo sapiens
uuccaaaucuugaaucaaagcuu

SEQ ID NO: 10495 - RNA, 23 nt, Homo sapiens
uccaaaucuugaaucaaagcuuc

SEQ ID NO: 10496 - RNA, 23 nt, Homo sapiens
ccaaaucuugaaucaaagcuucu

SEQ ID NO: 10497 - RNA, 23 nt, Homo sapiens
caaaucuugaaucaaagcuucuu

SEQ ID NO: 10498 - RNA, 23 nt, Homo sapiens
aaaucuugaaucaaagcuucuuu

SEQ ID NO: 10499 - RNA, 23 nt, Homo sapiens
aaucuugaaucaaagcuucuuuu

SEQ ID NO: 10500 - RNA, 23 nt, Homo sapiens
aucuugaaucaaagcuucuuuug

SEQ ID NO: 10501 - RNA, 23 nt, Homo sapiens
ucuugaaucaaagcuucuuuuga

SEQ ID NO: 10502 - RNA, 23 nt, Homo sapiens
cuugaaucaaagcuucuuuugau

SEQ ID NO: 10503 - RNA, 23 nt, Homo sapiens
uugaaucaaagcuucuuuugauc

SEQ ID NO: 10504 - RNA, 23 nt, Homo sapiens
ugaaucaaagcuucuuuugaucc

SEQ ID NO: 10505 - RNA, 23 nt, Homo sapiens
gaaucaaagcuucuuuugauccu

SEQ ID NO: 10506 - RNA, 23 nt, Homo sapiens
aaucaaagcuucuuuugauccuu

SEQ ID NO: 10507 - RNA, 23 nt, Homo sapiens
aucaaagcuucuuuugauccuug

SEQ ID NO: 10508 - RNA, 23 nt, Homo sapiens
ucaaagcuucuuuugauccuugu

SEQ ID NO: 10509 - RNA, 23 nt, Homo sapiens
caaagcuucuuuugauccuugua

SEQ ID NO: 10510 - RNA, 23 nt, Homo sapiens
aaagcuucuuuugauccuuguau

SEQ ID NO: 10511 - RNA, 23 nt, Homo sapiens
aagcuucuuuugauccuuguauu

SEQ ID NO: 10512 - RNA, 23 nt, Homo sapiens
agcuucuuuugauccuuguauuu

SEQ ID NO: 10513 - RNA, 23 nt, Homo sapiens
gcuucuuuugauccuuguauuuc

SEQ ID NO: 10514 - RNA, 23 nt, Homo sapiens
cuucuuuugauccuuguauuuca

SEQ ID NO: 10515 - RNA, 23 nt, Homo sapiens
uucuuuugauccuuguauuucau

SEQ ID NO: 10516 - RNA, 23 nt, Homo sapiens
ucuuuugauccuuguauuucaug

SEQ ID NO: 10517 - RNA, 23 nt, Homo sapiens
cuuuugauccuuguauuucauga

SEQ ID NO: 10518 - RNA, 23 nt, Homo sapiens
uuuugauccuuguauuucaugau

SEQ ID NO: 10519 - RNA, 23 nt, Homo sapiens
uuugauccuuguauuucaugauc

SEQ ID NO: 10520 - RNA, 23 nt, Homo sapiens
uugauccuuguauuucaugauca

SEQ ID NO: 10521 - RNA, 23 nt, Homo sapiens
ugauccuuguauuucaugaucag

SEQ ID NO: 10522 - RNA, 23 nt, Homo sapiens
gauccuuguauuucaugaucagg

SEQ ID NO: 10523 - RNA, 23 nt, Homo sapiens
auccuuguauuucaugaucagga

SEQ ID NO: 10524 - RNA, 23 nt, Homo sapiens
uccuuguauuucaugaucaggag

SEQ ID NO: 10525 - RNA, 23 nt, Homo sapiens
ccuuguauuucaugaucaggagu

SEQ ID NO: 10526 - RNA, 23 nt, Homo sapiens
cuuguauuucaugaucaggaguu

SEQ ID NO: 10527 - RNA, 23 nt, Homo sapiens
uuguauuucaugaucaggaguuc

SEQ ID NO: 10528 - RNA, 23 nt, Homo sapiens
uguauuucaugaucaggaguucu

SEQ ID NO: 10529 - RNA, 23 nt, Homo sapiens
guauuucaugaucaggaguucuu

SEQ ID NO: 10530 - RNA, 23 nt, Homo sapiens
uauuucaugaucaggaguucuug

SEQ ID NO: 10531 - RNA, 23 nt, Homo sapiens
auuucaugaucaggaguucuugg

SEQ ID NO: 10532 - RNA, 23 nt, Homo sapiens
uuucaugaucaggaguucuuggu

SEQ ID NO: 10533 - RNA, 23 nt, Homo sapiens
uucaugaucaggaguucuuggua

SEQ ID NO: 10534 - RNA, 23 nt, Homo sapiens
ucaugaucaggaguucuugguau

SEQ ID NO: 10535 - RNA, 23 nt, Homo sapiens
caugaucaggaguucuugguaug

SEQ ID NO: 10536 - RNA, 23 nt, Homo sapiens
augaucaggaguucuugguaugg

SEQ ID NO: 10537 - RNA, 23 nt, Homo sapiens
ugaucaggaguucuugguauggg

SEQ ID NO: 10538 - RNA, 23 nt, Homo sapiens
gaucaggaguucuugguaugggc

SEQ ID NO: 10539 - RNA, 23 nt, Homo sapiens
aucaggaguucuugguaugggcu

SEQ ID NO: 10540 - RNA, 23 nt, Homo sapiens
ucaggaguucuugguaugggcuu

SEQ ID NO: 10541 - RNA, 23 nt, Homo sapiens
caggaguucuugguaugggcuua

SEQ ID NO: 10542 - RNA, 23 nt, Homo sapiens
aggaguucuugguaugggcuuag

SEQ ID NO: 10543 - RNA, 23 nt, Homo sapiens
ggaguucuugguaugggcuuagc

SEQ ID NO: 10544 - RNA, 23 nt, Homo sapiens
gaguucuugguaugggcuuagca

SEQ ID NO: 10545 - RNA, 23 nt, Homo sapiens
aguucuugguaugggcuuagcau

SEQ ID NO: 10546 - RNA, 23 nt, Homo sapiens
guucuugguaugggcuuagcauu

SEQ ID NO: 10547 - RNA, 23 nt, Homo sapiens
uucuugguaugggcuuagcauuu

SEQ ID NO: 10548 - RNA, 23 nt, Homo sapiens
ucuugguaugggcuuagcauuug

SEQ ID NO: 10549 - RNA, 23 nt, Homo sapiens
cuugguaugggcuuagcauuugc

SEQ ID NO: 10550 - RNA, 23 nt, Homo sapiens
uugguaugggcuuagcauuugca

SEQ ID NO: 10551 - RNA, 23 nt, Homo sapiens
ugguaugggcuuagcauuugcag

SEQ ID NO: 10552 - RNA, 23 nt, Homo sapiens
gguaugggcuuagcauuugcagu

SEQ ID NO: 10553 - RNA, 23 nt, Homo sapiens
guaugggcuuagcauuugcaguu

SEQ ID NO: 10554 - RNA, 23 nt, Homo sapiens
uaugggcuuagcauuugcaguuu

SEQ ID NO: 10555 - RNA, 23 nt, Homo sapiens
augggcuuagcauuugcaguuug

SEQ ID NO: 10556 - RNA, 23 nt, Homo sapiens
ugggcuuagcauuugcaguuugg

SEQ ID NO: 10557 - RNA, 23 nt, Homo sapiens
gggcuuagcauuugcaguuuggg

SEQ ID NO: 10558 - RNA, 23 nt, Homo sapiens
ggcuuagcauuugcaguuuggga

SEQ ID NO: 10559 - RNA, 23 nt, Homo sapiens
gcuuagcauuugcaguuugggau

SEQ ID NO: 10560 - RNA, 23 nt, Homo sapiens
cuuagcauuugcaguuugggaug

SEQ ID NO: 10561 - RNA, 23 nt, Homo sapiens
uuagcauuugcaguuugggaugg

SEQ ID NO: 10562 - RNA, 23 nt, Homo sapiens
uagcauuugcaguuugggauggc

SEQ ID NO: 10563 - RNA, 23 nt, Homo sapiens
agcauuugcaguuugggauggcu

SEQ ID NO: 10564 - RNA, 23 nt, Homo sapiens
gcauuugcaguuugggauggcuu

SEQ ID NO: 10565 - RNA, 23 nt, Homo sapiens
cauuugcaguuugggauggcuuu

SEQ ID NO: 10566 - RNA, 23 nt, Homo sapiens
auuugcaguuugggauggcuuug

SEQ ID NO: 10567 - RNA, 23 nt, Homo sapiens
uuugcaguuugggauggcuuugc

SEQ ID NO: 10568 - RNA, 23 nt, Homo sapiens
uugcaguuugggauggcuuugca

SEQ ID NO: 10569 - RNA, 23 nt, Homo sapiens
ugcaguuugggauggcuuugcau

SEQ ID NO: 10570 - RNA, 23 nt, Homo sapiens
gcaguuugggauggcuuugcauu

SEQ ID NO: 10571 - RNA, 23 nt, Homo sapiens
caguuugggauggcuuugcauuu

SEQ ID NO: 10572 - RNA, 23 nt, Homo sapiens
aguuugggauggcuuugcauuua

SEQ ID NO: 10573 - RNA, 23 nt, Homo sapiens
guuugggauggcuuugcauuuau

SEQ ID NO: 10574 - RNA, 23 nt, Homo sapiens
uuugggauggcuuugcauuuaua

SEQ ID NO: 10575 - RNA, 23 nt, Homo sapiens
uugggauggcuuugcauuuauag

SEQ ID NO: 10576 - RNA, 23 nt, Homo sapiens
ugggauggcuuugcauuuauagg

SEQ ID NO: 10577 - RNA, 23 nt, Homo sapiens
gggauggcuuugcauuuauaggu

SEQ ID NO: 10578 - RNA, 23 nt, Homo sapiens
ggauggcuuugcauuuauagguu

SEQ ID NO: 10579 - RNA, 23 nt, Homo sapiens
gauggcuuugcauuuauagguug

SEQ ID NO: 10580 - RNA, 23 nt, Homo sapiens
auggcuuugcauuuauagguugg

SEQ ID NO: 10581 - RNA, 23 nt, Homo sapiens
uggcuuugcauuuauagguuggc

SEQ ID NO: 10582 - RNA, 23 nt, Homo sapiens
ggcuuugcauuuauagguuggcc

SEQ ID NO: 10583 - RNA, 23 nt, Homo sapiens
gcuuugcauuuauagguuggcca

SEQ ID NO: 10584 - RNA, 23 nt, Homo sapiens
cuuugcauuuauagguuggccag

SEQ ID NO: 10585 - RNA, 23 nt, Homo sapiens
uuugcauuuauagguuggccagc

SEQ ID NO: 10586 - RNA, 23 nt, Homo sapiens
uugcauuuauagguuggccagcu

SEQ ID NO: 10587 - RNA, 23 nt, Homo sapiens
ugcauuuauagguuggccagcug

SEQ ID NO: 10588 - RNA, 23 nt, Homo sapiens
gcauuuauagguuggccagcuga

SEQ ID NO: 10589 - RNA, 23 nt, Homo sapiens
cauuuauagguuggccagcugag

SEQ ID NO: 10590 - RNA, 23 nt, Homo sapiens
auuuauagguuggccagcugagg

SEQ ID NO: 10591 - RNA, 23 nt, Homo sapiens
uuuauagguuggccagcugagga

SEQ ID NO: 10592 - RNA, 23 nt, Homo sapiens
uuauagguuggccagcugaggac

SEQ ID NO: 10593 - RNA, 23 nt, Homo sapiens
uauagguuggccagcugaggacu

SEQ ID NO: 10594 - RNA, 23 nt, Homo sapiens
auagguuggccagcugaggacug

SEQ ID NO: 10595 - RNA, 23 nt, Homo sapiens
uagguuggccagcugaggacugu

SEQ ID NO: 10596 - RNA, 23 nt, Homo sapiens
agguuggccagcugaggacuguu

SEQ ID NO: 10597 - RNA, 23 nt, Homo sapiens
gguuggccagcugaggacuguug

SEQ ID NO: 10598 - RNA, 23 nt, Homo sapiens
guuggccagcugaggacuguuga

SEQ ID NO: 10599 - RNA, 23 nt, Homo sapiens
uuggccagcugaggacuguugau

SEQ ID NO: 10600 - RNA, 23 nt, Homo sapiens
uggccagcugaggacuguugaua

SEQ ID NO: 10601 - RNA, 23 nt, Homo sapiens
ggccagcugaggacuguugauag

SEQ ID NO: 10602 - RNA, 23 nt, Homo sapiens
gccagcugaggacuguugauagu

SEQ ID NO: 10603 - RNA, 23 nt, Homo sapiens
ccagcugaggacuguugauaguu

SEQ ID NO: 10604 - RNA, 23 nt, Homo sapiens
cagcugaggacuguugauaguug

SEQ ID NO: 10605 - RNA, 23 nt, Homo sapiens
agcugaggacuguugauaguugg

SEQ ID NO: 10606 - RNA, 23 nt, Homo sapiens
gcugaggacuguugauaguugga

SEQ ID NO: 10607 - RNA, 23 nt, Homo sapiens
cugaggacuguugauaguuggaa

SEQ ID NO: 10608 - RNA, 23 nt, Homo sapiens
ugaggacuguugauaguuggaau

SEQ ID NO: 10609 - RNA, 23 nt, Homo sapiens
gaggacuguugauaguuggaauc

SEQ ID NO: 10610 - RNA, 23 nt, Homo sapiens
aggacuguugauaguuggaaucc

SEQ ID NO: 10611 - RNA, 23 nt, Homo sapiens
ggacuguugauaguuggaaucca

SEQ ID NO: 10612 - RNA, 23 nt, Homo sapiens
gacuguugauaguuggaauccau

SEQ ID NO: 10613 - RNA, 23 nt, Homo sapiens
acuguugauaguuggaauccaua

SEQ ID NO: 10614 - RNA, 23 nt, Homo sapiens
cuguugauaguuggaauccauag

SEQ ID NO: 10615 - RNA, 23 nt, Homo sapiens
uguugauaguuggaauccauagc

SEQ ID NO: 10616 - RNA, 23 nt, Homo sapiens
guugauaguuggaauccauagcg

SEQ ID NO: 10617 - RNA, 23 nt, Homo sapiens
uugauaguuggaauccauagcgg

SEQ ID NO: 10618 - RNA, 23 nt, Homo sapiens
ugauaguuggaauccauagcgga

SEQ ID NO: 10619 - RNA, 23 nt, Homo sapiens
gauaguuggaauccauagcggaa

SEQ ID NO: 10620 - RNA, 23 nt, Homo sapiens
auaguuggaauccauagcggaag

SEQ ID NO: 10621 - RNA, 23 nt, Homo sapiens
uaguuggaauccauagcggaagg

SEQ ID NO: 10622 - RNA, 23 nt, Homo sapiens
aguuggaauccauagcggaaggg

SEQ ID NO: 10623 - RNA, 23 nt, Homo sapiens
guuggaauccauagcggaaggga

SEQ ID NO: 10624 - RNA, 23 nt, Homo sapiens
uuggaauccauagcggaagggau

SEQ ID NO: 10625 - RNA, 23 nt, Homo sapiens
uggaauccauagcggaagggauu

SEQ ID NO: 10626 - RNA, 23 nt, Homo sapiens
ggaauccauagcggaagggauuu

SEQ ID NO: 10627 - RNA, 23 nt, Homo sapiens
gaauccauagcggaagggauuuu

SEQ ID NO: 10628 - RNA, 23 nt, Homo sapiens
aauccauagcggaagggauuuua

SEQ ID NO: 10629 - RNA, 23 nt, Homo sapiens
auccauagcggaagggauuuuac

SEQ ID NO: 10630 - RNA, 23 nt, Homo sapiens
uccauagcggaagggauuuuacu

SEQ ID NO: 10631 - RNA, 23 nt, Homo sapiens
ccauagcggaagggauuuuacug

SEQ ID NO: 10632 - RNA, 23 nt, Homo sapiens
cauagcggaagggauuuuacugc

SEQ ID NO: 10633 - RNA, 23 nt, Homo sapiens
auagcggaagggauuuuacugcu

SEQ ID NO: 10634 - RNA, 23 nt, Homo sapiens
uagcggaagggauuuuacugcua

SEQ ID NO: 10635 - RNA, 23 nt, Homo sapiens
agcggaagggauuuuacugcuau

SEQ ID NO: 10636 - RNA, 23 nt, Homo sapiens
gcggaagggauuuuacugcuauu

SEQ ID NO: 10637 - RNA, 23 nt, Homo sapiens
cggaagggauuuuacugcuauug

SEQ ID NO: 10638 - RNA, 23 nt, Homo sapiens
ggaagggauuuuacugcuauugu

SEQ ID NO: 10639 - RNA, 23 nt, Homo sapiens
gaagggauuuuacugcuauugua

SEQ ID NO: 10640 - RNA, 23 nt, Homo sapiens
aagggauuuuacugcuauuguaa

SEQ ID NO: 10641 - RNA, 23 nt, Homo sapiens
agggauuuuacugcuauuguaau

SEQ ID NO: 10642 - RNA, 23 nt, Homo sapiens
gggauuuuacugcuauuguaauc

SEQ ID NO: 10643 - RNA, 23 nt, Homo sapiens
ggauuuuacugcuauuguaauca

SEQ ID NO: 10644 - RNA, 23 nt, Homo sapiens
gauuuuacugcuauuguaaucag

SEQ ID NO: 10645 - RNA, 23 nt, Homo sapiens
auuuuacugcuauuguaaucagg

SEQ ID NO: 10646 - RNA, 23 nt, Homo sapiens
uuuuacugcuauuguaaucaggc

SEQ ID NO: 10647 - RNA, 23 nt, Homo sapiens
uuuacugcuauuguaaucaggcu

SEQ ID NO: 10648 - RNA, 23 nt, Homo sapiens
uuacugcuauuguaaucaggcug

SEQ ID NO: 10649 - RNA, 23 nt, Homo sapiens
uacugcuauuguaaucaggcugu

SEQ ID NO: 10650 - RNA, 23 nt, Homo sapiens
acugcuauuguaaucaggcugug

SEQ ID NO: 10651 - RNA, 23 nt, Homo sapiens
cugcuauuguaaucaggcuguga

SEQ ID NO: 10652 - RNA, 23 nt, Homo sapiens
ugcuauuguaaucaggcugugau

SEQ ID NO: 10653 - RNA, 23 nt, Homo sapiens
gcuauuguaaucaggcugugaug

SEQ ID NO: 10654 - RNA, 23 nt, Homo sapiens
cuauuguaaucaggcugugaugg

SEQ ID NO: 10655 - RNA, 23 nt, Homo sapiens
uauuguaaucaggcugugauggu

SEQ ID NO: 10656 - RNA, 23 nt, Homo sapiens
auuguaaucaggcugugauggua

SEQ ID NO: 10657 - RNA, 23 nt, Homo sapiens
uuguaaucaggcugugaugguaa

SEQ ID NO: 10658 - RNA, 23 nt, Homo sapiens
uguaaucaggcugugaugguaau

SEQ ID NO: 10659 - RNA, 23 nt, Homo sapiens
guaaucaggcugugaugguaaua

SEQ ID NO: 10660 - RNA, 23 nt, Homo sapiens
uaaucaggcugugaugguaauau

SEQ ID NO: 10661 - RNA, 23 nt, Homo sapiens
aaucaggcugugaugguaauaug

SEQ ID NO: 10662 - RNA, 23 nt, Homo sapiens
aucaggcugugaugguaauaugg

SEQ ID NO: 10663 - RNA, 23 nt, Homo sapiens
ucaggcugugaugguaauaugga

SEQ ID NO: 10664 - RNA, 23 nt, Homo sapiens
caggcugugaugguaauauggag

SEQ ID NO: 10665 - RNA, 23 nt, Homo sapiens
aggcugugaugguaauauggagc

SEQ ID NO: 10666 - RNA, 23 nt, Homo sapiens
ggcugugaugguaauauggagcu

SEQ ID NO: 10667 - RNA, 23 nt, Homo sapiens
gcugugaugguaauauggagcug

SEQ ID NO: 10668 - RNA, 23 nt, Homo sapiens
cugugaugguaauauggagcuga

SEQ ID NO: 10669 - RNA, 23 nt, Homo sapiens
ugugaugguaauauggagcugag

SEQ ID NO: 10670 - RNA, 23 nt, Homo sapiens
gugaugguaauauggagcugagg

SEQ ID NO: 10671 - RNA, 23 nt, Homo sapiens
ugaugguaauauggagcugagga

SEQ ID NO: 10672 - RNA, 23 nt, Homo sapiens
gaugguaauauggagcugaggaa

SEQ ID NO: 10673 - RNA, 23 nt, Homo sapiens
augguaauauggagcugaggaag

SEQ ID NO: 10674 - RNA, 23 nt, Homo sapiens
ugguaauauggagcugaggaagc

SEQ ID NO: 10675 - RNA, 23 nt, Homo sapiens
gguaauauggagcugaggaagcu

SEQ ID NO: 10676 - RNA, 23 nt, Homo sapiens
guaauauggagcugaggaagcug

SEQ ID NO: 10677 - RNA, 23 nt, Homo sapiens
uaauauggagcugaggaagcugg

SEQ ID NO: 10678 - RNA, 23 nt, Homo sapiens
aauauggagcugaggaagcuggc

SEQ ID NO: 10679 - RNA, 23 nt, Homo sapiens
auauggagcugaggaagcuggcu

SEQ ID NO: 10680 - RNA, 23 nt, Homo sapiens
uauggagcugaggaagcuggcug

SEQ ID NO: 10681 - RNA, 23 nt, Homo sapiens
auggagcugaggaagcuggcugg

SEQ ID NO: 10682 - RNA, 23 nt, Homo sapiens
uggagcugaggaagcuggcuggg

SEQ ID NO: 10683 - RNA, 23 nt, Homo sapiens
ggagcugaggaagcuggcugggg

SEQ ID NO: 10684 - RNA, 23 nt, Homo sapiens
gagcugaggaagcuggcugggga

SEQ ID NO: 10685 - RNA, 23 nt, Homo sapiens
agcugaggaagcuggcuggggac

SEQ ID NO: 10686 - RNA, 23 nt, Homo sapiens
gcugaggaagcuggcuggggacu

SEQ ID NO: 10687 - RNA, 23 nt, Homo sapiens
cugaggaagcuggcuggggacug

SEQ ID NO: 10688 - RNA, 23 nt, Homo sapiens
ugaggaagcuggcuggggacugg

SEQ ID NO: 10689 - RNA, 23 nt, Homo sapiens
gaggaagcuggcuggggacuggu

SEQ ID NO: 10690 - RNA, 23 nt, Homo sapiens
aggaagcuggcuggggacugguu

SEQ ID NO: 10691 - RNA, 23 nt, Homo sapiens
ggaagcuggcuggggacugguua

SEQ ID NO: 10692 - RNA, 23 nt, Homo sapiens
gaagcuggcuggggacugguuau

SEQ ID NO: 10693 - RNA, 23 nt, Homo sapiens
aagcuggcuggggacugguuaua

SEQ ID NO: 10694 - RNA, 23 nt, Homo sapiens
agcuggcuggggacugguuauag

SEQ ID NO: 10695 - RNA, 23 nt, Homo sapiens
gcuggcuggggacugguuauagg

SEQ ID NO: 10696 - RNA, 23 nt, Homo sapiens
cuggcuggggacugguuauaggu

SEQ ID NO: 10697 - RNA, 23 nt, Homo sapiens
uggcuggggacugguuauaggug

SEQ ID NO: 10698 - RNA, 23 nt, Homo sapiens
ggcuggggacugguuauaggugg

SEQ ID NO: 10699 - RNA, 23 nt, Homo sapiens
gcuggggacugguuauagguggu

SEQ ID NO: 10700 - RNA, 23 nt, Homo sapiens
cuggggacugguuauaggugguu

SEQ ID NO: 10701 - RNA, 23 nt, Homo sapiens
uggggacugguuauaggugguug

SEQ ID NO: 10702 - RNA, 23 nt, Homo sapiens
ggggacugguuauaggugguugu

SEQ ID NO: 10703 - RNA, 23 nt, Homo sapiens
gggacugguuauaggugguugua

SEQ ID NO: 10704 - RNA, 23 nt, Homo sapiens
ggacugguuauaggugguuguaa

SEQ ID NO: 10705 - RNA, 23 nt, Homo sapiens
gacugguuauaggugguuguaac

SEQ ID NO: 10706 - RNA, 23 nt, Homo sapiens
acugguuauaggugguuguaacc

SEQ ID NO: 10707 - RNA, 23 nt, Homo sapiens
cugguuauaggugguuguaaccc

SEQ ID NO: 10708 - RNA, 23 nt, Homo sapiens
ugguuauaggugguuguaacccu

SEQ ID NO: 10709 - RNA, 23 nt, Homo sapiens
gguuauaggugguuguaacccuu

SEQ ID NO: 10710 - RNA, 23 nt, Homo sapiens
guuauaggugguuguaacccuuu

SEQ ID NO: 10711 - RNA, 23 nt, Homo sapiens
uuauaggugguuguaacccuuug

SEQ ID NO: 10712 - RNA, 23 nt, Homo sapiens
uauaggugguuguaacccuuugg

SEQ ID NO: 10713 - RNA, 23 nt, Homo sapiens
auaggugguuguaacccuuuggc

SEQ ID NO: 10714 - RNA, 23 nt, Homo sapiens
uaggugguuguaacccuuuggcc

SEQ ID NO: 10715 - RNA, 23 nt, Homo sapiens
aggugguuguaacccuuuggccu

SEQ ID NO: 10716 - RNA, 23 nt, Homo sapiens
ggugguuguaacccuuuggccug

SEQ ID NO: 10717 - RNA, 23 nt, Homo sapiens
gugguuguaacccuuuggccugg

SEQ ID NO: 10718 - RNA, 23 nt, Homo sapiens
ugguuguaacccuuuggccuggg

SEQ ID NO: 10719 - RNA, 23 nt, Homo sapiens
gguuguaacccuuuggccugggu

SEQ ID NO: 10720 - RNA, 23 nt, Homo sapiens
guuguaacccuuuggccuggguu

SEQ ID NO: 10721 - RNA, 23 nt, Homo sapiens
uuguaacccuuuggccuggguug

SEQ ID NO: 10722 - RNA, 23 nt, Homo sapiens
uguaacccuuuggccuggguugg

SEQ ID NO: 10723 - RNA, 23 nt, Homo sapiens
guaacccuuuggccuggguugga

SEQ ID NO: 10724 - RNA, 23 nt, Homo sapiens
uaacccuuuggccuggguuggag

SEQ ID NO: 10725 - RNA, 23 nt, Homo sapiens
aacccuuuggccuggguuggagc

SEQ ID NO: 10726 - RNA, 23 nt, Homo sapiens
acccuuuggccuggguuggagcc

SEQ ID NO: 10727 - RNA, 23 nt, Homo sapiens
cccuuuggccuggguuggagcca

SEQ ID NO: 10728 - RNA, 23 nt, Homo sapiens
ccuuuggccuggguuggagccag

SEQ ID NO: 10729 - RNA, 23 nt, Homo sapiens
cuuuggccuggguuggagccagc

SEQ ID NO: 10730 - RNA, 23 nt, Homo sapiens
uuuggccuggguuggagccagca

SEQ ID NO: 10731 - RNA, 23 nt, Homo sapiens
uuggccuggguuggagccagcau

SEQ ID NO: 10732 - RNA, 23 nt, Homo sapiens
uggccuggguuggagccagcaug

SEQ ID NO: 10733 - RNA, 23 nt, Homo sapiens
ggccuggguuggagccagcaugc

SEQ ID NO: 10734 - RNA, 23 nt, Homo sapiens
gccuggguuggagccagcaugcu

SEQ ID NO: 10735 - RNA, 23 nt, Homo sapiens
ccuggguuggagccagcaugcug

SEQ ID NO: 10736 - RNA, 23 nt, Homo sapiens
cuggguuggagccagcaugcugc

SEQ ID NO: 10737 - RNA, 23 nt, Homo sapiens
uggguuggagccagcaugcugcu

SEQ ID NO: 10738 - RNA, 23 nt, Homo sapiens
ggguuggagccagcaugcugcug

SEQ ID NO: 10739 - RNA, 23 nt, Homo sapiens
gguuggagccagcaugcugcugg

SEQ ID NO: 10740 - RNA, 23 nt, Homo sapiens
guuggagccagcaugcugcuggg

SEQ ID NO: 10741 - RNA, 23 nt, Homo sapiens
uuggagccagcaugcugcugggg

SEQ ID NO: 10742 - RNA, 23 nt, Homo sapiens
uggagccagcaugcugcugggga

SEQ ID NO: 10743 - RNA, 23 nt, Homo sapiens
ggagccagcaugcugcuggggag

SEQ ID NO: 10744 - RNA, 23 nt, Homo sapiens
gagccagcaugcugcuggggaga

SEQ ID NO: 10745 - RNA, 23 nt, Homo sapiens
agccagcaugcugcuggggagaa

SEQ ID NO: 10746 - RNA, 23 nt, Homo sapiens
gccagcaugcugcuggggagaag

SEQ ID NO: 10747 - RNA, 23 nt, Homo sapiens
ccagcaugcugcuggggagaagc

SEQ ID NO: 10748 - RNA, 23 nt, Homo sapiens
cagcaugcugcuggggagaagca

SEQ ID NO: 10749 - RNA, 23 nt, Homo sapiens
agcaugcugcuggggagaagcag

SEQ ID NO: 10750 - RNA, 23 nt, Homo sapiens
gcaugcugcuggggagaagcagg

SEQ ID NO: 10751 - RNA, 23 nt, Homo sapiens
caugcugcuggggagaagcaggg

SEQ ID NO: 10752 - RNA, 23 nt, Homo sapiens
augcugcuggggagaagcaggga

SEQ ID NO: 10753 - RNA, 23 nt, Homo sapiens
ugcugcuggggagaagcagggaa

SEQ ID NO: 10754 - RNA, 23 nt, Homo sapiens
gcugcuggggagaagcagggaaa

SEQ ID NO: 10755 - RNA, 23 nt, Homo sapiens
cugcuggggagaagcagggaaag

SEQ ID NO: 10756 - RNA, 23 nt, Homo sapiens
ugcuggggagaagcagggaaagc

SEQ ID NO: 10757 - RNA, 23 nt, Homo sapiens
gcuggggagaagcagggaaagca

SEQ ID NO: 10758 - RNA, 23 nt, Homo sapiens
cuggggagaagcagggaaagcag

SEQ ID NO: 10759 - RNA, 23 nt, Homo sapiens
uggggagaagcagggaaagcaga

SEQ ID NO: 10760 - RNA, 23 nt, Homo sapiens
ggggagaagcagggaaagcagag

SEQ ID NO: 10761 - RNA, 23 nt, Homo sapiens
gggagaagcagggaaagcagagg

SEQ ID NO: 10762 - RNA, 23 nt, Homo sapiens
ggagaagcagggaaagcagagga

SEQ ID NO: 10763 - RNA, 23 nt, Homo sapiens
gagaagcagggaaagcagaggag

SEQ ID NO: 10764 - RNA, 23 nt, Homo sapiens
agaagcagggaaagcagaggagg

SEQ ID NO: 10765 - RNA, 23 nt, Homo sapiens
gaagcagggaaagcagaggagga

SEQ ID NO: 10766 - RNA, 23 nt, Homo sapiens
aagcagggaaagcagaggaggac

SEQ ID NO: 10767 - RNA, 23 nt, Homo sapiens
agcagggaaagcagaggaggaca

SEQ ID NO: 10768 - RNA, 23 nt, Homo sapiens
gcagggaaagcagaggaggacau

SEQ ID NO: 10769 - RNA, 23 nt, Homo sapiens
cagggaaagcagaggaggacaug

SEQ ID NO: 10770 - RNA, 23 nt, Homo sapiens
agggaaagcagaggaggacaugg

SEQ ID NO: 10771 - RNA, 23 nt, Homo sapiens
gggaaagcagaggaggacauggu

SEQ ID NO: 10772 - RNA, 23 nt, Homo sapiens
ggaaagcagaggaggacauggug

SEQ ID NO: 10773 - RNA, 23 nt, Homo sapiens
gaaagcagaggaggacaugguga

SEQ ID NO: 10774 - RNA, 23 nt, Homo sapiens
aaagcagaggaggacauggugau

SEQ ID NO: 10775 - RNA, 23 nt, Homo sapiens
aagcagaggaggacauggugaug

SEQ ID NO: 10776 - RNA, 23 nt, Homo sapiens
agcagaggaggacauggugaugu

SEQ ID NO: 10777 - RNA, 23 nt, Homo sapiens
gcagaggaggacauggugaugug

SEQ ID NO: 10778 - RNA, 23 nt, Homo sapiens
cagaggaggacauggugauguga

SEQ ID NO: 10779 - RNA, 23 nt, Homo sapiens
agaggaggacauggugaugugag

SEQ ID NO: 10780 - RNA, 23 nt, Homo sapiens
gaggaggacauggugaugugaga

SEQ ID NO: 10781 - RNA, 23 nt, Homo sapiens
aggaggacauggugaugugagag

SEQ ID NO: 10782 - RNA, 23 nt, Homo sapiens
ggaggacauggugaugugagagc

SEQ ID NO: 10783 - RNA, 23 nt, Homo sapiens
gaggacauggugaugugagagcu

SEQ ID NO: 10784 - RNA, 23 nt, Homo sapiens
aggacauggugaugugagagcuc

SEQ ID NO: 10785 - RNA, 23 nt, Homo sapiens
ggacauggugaugugagagcuca

SEQ ID NO: 10786 - RNA, 23 nt, Homo sapiens
gacauggugaugugagagcucag

SEQ ID NO: 10787 - RNA, 23 nt, Homo sapiens
acauggugaugugagagcucagu

SEQ ID NO: 10788 - RNA, 23 nt, Homo sapiens
cauggugaugugagagcucagug

SEQ ID NO: 10789 - RNA, 23 nt, Homo sapiens
auggugaugugagagcucagugu

SEQ ID NO: 10790 - RNA, 23 nt, Homo sapiens
uggugaugugagagcucaguguu

SEQ ID NO: 10791 - RNA, 23 nt, Homo sapiens
ggugaugugagagcucaguguug

SEQ ID NO: 10792 - RNA, 23 nt, Homo sapiens
gugaugugagagcucaguguuga

SEQ ID NO: 10793 - RNA, 23 nt, Homo sapiens
ugaugugagagcucaguguugag

SEQ ID NO: 10794 - RNA, 23 nt, Homo sapiens
gaugugagagcucaguguugagg

SEQ ID NO: 10795 - RNA, 23 nt, Homo sapiens
augugagagcucaguguugagga

SEQ ID NO: 10796 - RNA, 23 nt, Homo sapiens
ugugagagcucaguguugaggag

SEQ ID NO: 10797 - RNA, 23 nt, Homo sapiens
gugagagcucaguguugaggagg

SEQ ID NO: 10798 - RNA, 23 nt, Homo sapiens
ugagagcucaguguugaggaggc

SEQ ID NO: 10799 - RNA, 23 nt, Homo sapiens
gagagcucaguguugaggaggca

SEQ ID NO: 10800 - RNA, 23 nt, Homo sapiens
agagcucaguguugaggaggcag

SEQ ID NO: 10801 - RNA, 23 nt, Homo sapiens
gagcucaguguugaggaggcaga

SEQ ID NO: 10802 - RNA, 23 nt, Homo sapiens
agcucaguguugaggaggcagaa

SEQ ID NO: 10803 - RNA, 23 nt, Homo sapiens
gcucaguguugaggaggcagaaa

SEQ ID NO: 10804 - RNA, 23 nt, Homo sapiens
cucaguguugaggaggcagaaaa

SEQ ID NO: 10805 - RNA, 23 nt, Homo sapiens
ucaguguugaggaggcagaaaau

SEQ ID NO: 10806 - RNA, 23 nt, Homo sapiens
caguguugaggaggcagaaaauc

SEQ ID NO: 10807 - RNA, 23 nt, Homo sapiens
aguguugaggaggcagaaaaucu

SEQ ID NO: 10808 - RNA, 23 nt, Homo sapiens
guguugaggaggcagaaaaucuu

SEQ ID NO: 10809 - RNA, 23 nt, Homo sapiens
uguugaggaggcagaaaaucuuu

SEQ ID NO: 10810 - RNA, 23 nt, Homo sapiens
guugaggaggcagaaaaucuuug

SEQ ID NO: 10811 - RNA, 23 nt, Homo sapiens
uugaggaggcagaaaaucuuugc

SEQ ID NO: 10812 - RNA, 23 nt, Homo sapiens
ugaggaggcagaaaaucuuugcu

SEQ ID NO: 10813 - RNA, 23 nt, Homo sapiens
gaggaggcagaaaaucuuugcuc

SEQ ID NO: 10814 - RNA, 23 nt, Homo sapiens
aggaggcagaaaaucuuugcucu

SEQ ID NO: 10815 - RNA, 23 nt, Homo sapiens
ggaggcagaaaaucuuugcucug

SEQ ID NO: 10816 - RNA, 23 nt, Homo sapiens
gaggcagaaaaucuuugcucugu

SEQ ID NO: 10817 - RNA, 23 nt, Homo sapiens
aggcagaaaaucuuugcucugua

SEQ ID NO: 10818 - RNA, 23 nt, Homo sapiens
ggcagaaaaucuuugcucuguac

SEQ ID NO: 10819 - RNA, 23 nt, Homo sapiens
gcagaaaaucuuugcucuguaca

SEQ ID NO: 10820 - RNA, 23 nt, Homo sapiens
cagaaaaucuuugcucuguacac

SEQ ID NO: 10821 - RNA, 23 nt, Homo sapiens
agaaaaucuuugcucuguacacu

SEQ ID NO: 10822 - RNA, 23 nt, Homo sapiens
gaaaaucuuugcucuguacacug

SEQ ID NO: 10823 - RNA, 23 nt, Homo sapiens
aaaaucuuugcucuguacacugg

SEQ ID NO: 10824 - RNA, 23 nt, Homo sapiens
aaaucuuugcucuguacacuggc

SEQ ID NO: 10825 - RNA, 23 nt, Homo sapiens
aaucuuugcucuguacacuggcg

SEQ ID NO: 10826 - RNA, 23 nt, Homo sapiens
aucuuugcucuguacacuggcgg

SEQ ID NO: 10827 - RNA, 23 nt, Homo sapiens
ucuuugcucuguacacuggcggg

SEQ ID NO: 10828 - RNA, 23 nt, Homo sapiens
cuuugcucuguacacuggcgggg

SEQ ID NO: 10829 - RNA, 23 nt, Homo sapiens
uuugcucuguacacuggcggggc

SEQ ID NO: 10830 - RNA, 23 nt, Homo sapiens
uugcucuguacacuggcggggcu

SEQ ID NO: 10831 - RNA, 23 nt, Homo sapiens
ugcucuguacacuggcggggcug

SEQ ID NO: 10832 - RNA, 23 nt, Homo sapiens
gcucuguacacuggcggggcugg

SEQ ID NO: 10833 - RNA, 23 nt, Homo sapiens
cucuguacacuggcggggcugga

SEQ ID NO: 10834 - RNA, 23 nt, Homo sapiens
ucuguacacuggcggggcuggau

SEQ ID NO: 10835 - RNA, 23 nt, Homo sapiens
cuguacacuggcggggcuggaug

SEQ ID NO: 10836 - RNA, 23 nt, Homo sapiens
uguacacuggcggggcuggauga

SEQ ID NO: 10837 - RNA, 23 nt, Homo sapiens
guacacuggcggggcuggaugau

SEQ ID NO: 10838 - RNA, 23 nt, Homo sapiens
uacacuggcggggcuggaugaua

SEQ ID NO: 10839 - RNA, 23 nt, Homo sapiens
acacuggcggggcuggaugauaa

SEQ ID NO: 10840 - RNA, 23 nt, Homo sapiens
cacuggcggggcuggaugauaau

SEQ ID NO: 10841 - RNA, 23 nt, Homo sapiens
acuggcggggcuggaugauaaug

SEQ ID NO: 10842 - RNA, 23 nt, Homo sapiens
cuggcggggcuggaugauaaugg

SEQ ID NO: 10843 - RNA, 23 nt, Homo sapiens
uggcggggcuggaugauaaugga

SEQ ID NO: 10844 - RNA, 23 nt, Homo sapiens
ggcggggcuggaugauaauggaa

SEQ ID NO: 10845 - RNA, 23 nt, Homo sapiens
gcggggcuggaugauaauggaag

SEQ ID NO: 10846 - RNA, 23 nt, Homo sapiens
cggggcuggaugauaauggaaga

SEQ ID NO: 10847 - RNA, 23 nt, Homo sapiens
ggggcuggaugauaauggaagac

SEQ ID NO: 10848 - RNA, 23 nt, Homo sapiens
gggcuggaugauaauggaagacu

SEQ ID NO: 10849 - RNA, 23 nt, Homo sapiens
ggcuggaugauaauggaagacug

SEQ ID NO: 10850 - RNA, 23 nt, Homo sapiens
gcuggaugauaauggaagacugu

SEQ ID NO: 10851 - RNA, 23 nt, Homo sapiens
cuggaugauaauggaagacuguu

SEQ ID NO: 10852 - RNA, 23 nt, Homo sapiens
uggaugauaauggaagacuguuu

SEQ ID NO: 10853 - RNA, 23 nt, Homo sapiens
ggaugauaauggaagacuguuug

SEQ ID NO: 10854 - RNA, 23 nt, Homo sapiens
gaugauaauggaagacuguuugg

SEQ ID NO: 10855 - RNA, 23 nt, Homo sapiens
augauaauggaagacuguuuggu

SEQ ID NO: 10856 - RNA, 23 nt, Homo sapiens
ugauaauggaagacuguuugguc

SEQ ID NO: 10857 - RNA, 23 nt, Homo sapiens
gauaauggaagacuguuuggucu

SEQ ID NO: 10858 - RNA, 23 nt, Homo sapiens
auaauggaagacuguuuggucug

SEQ ID NO: 10859 - RNA, 23 nt, Homo sapiens
uaauggaagacuguuuggucugg

SEQ ID NO: 10860 - RNA, 23 nt, Homo sapiens
aauggaagacuguuuggucuggc

SEQ ID NO: 10861 - RNA, 23 nt, Homo sapiens
auggaagacuguuuggucuggcu

SEQ ID NO: 10862 - RNA, 23 nt, Homo sapiens
uggaagacuguuuggucuggcua

SEQ ID NO: 10863 - RNA, 23 nt, Homo sapiens
ggaagacuguuuggucuggcuag

SEQ ID NO: 10864 - RNA, 23 nt, Homo sapiens
gaagacuguuuggucuggcuaga

SEQ ID NO: 10865 - RNA, 23 nt, Homo sapiens
aagacuguuuggucuggcuagag

SEQ ID NO: 10866 - RNA, 23 nt, Homo sapiens
agacuguuuggucuggcuagaga

SEQ ID NO: 10867 - RNA, 23 nt, Homo sapiens
gacuguuuggucuggcuagagaa

SEQ ID NO: 10868 - RNA, 23 nt, Homo sapiens
acuguuuggucuggcuagagaag

SEQ ID NO: 10869 - RNA, 23 nt, Homo sapiens
cuguuuggucuggcuagagaagc

SEQ ID NO: 10870 - RNA, 23 nt, Homo sapiens
uguuuggucuggcuagagaagcu

SEQ ID NO: 10871 - RNA, 23 nt, Homo sapiens
guuuggucuggcuagagaagcug

SEQ ID NO: 10872 - RNA, 23 nt, Homo sapiens
uuuggucuggcuagagaagcugg

SEQ ID NO: 10873 - RNA, 23 nt, Homo sapiens
uuggucuggcuagagaagcugga

SEQ ID NO: 10874 - RNA, 23 nt, Homo sapiens
uggucuggcuagagaagcuggag

SEQ ID NO: 10875 - RNA, 23 nt, Homo sapiens
ggucuggcuagagaagcuggagg

SEQ ID NO: 10876 - RNA, 23 nt, Homo sapiens
gucuggcuagagaagcuggaggu

SEQ ID NO: 10877 - RNA, 23 nt, Homo sapiens
ucuggcuagagaagcuggagguu

SEQ ID NO: 10878 - RNA, 23 nt, Homo sapiens
cuggcuagagaagcuggagguuu

SEQ ID NO: 10879 - RNA, 23 nt, Homo sapiens
uggcuagagaagcuggagguuuc

SEQ ID NO: 10880 - RNA, 23 nt, Homo sapiens
ggcuagagaagcuggagguuucu

SEQ ID NO: 10881 - RNA, 23 nt, Homo sapiens
gcuagagaagcuggagguuucug

SEQ ID NO: 10882 - RNA, 23 nt, Homo sapiens
cuagagaagcuggagguuucugg

SEQ ID NO: 10883 - RNA, 23 nt, Homo sapiens
uagagaagcuggagguuucuggu

SEQ ID NO: 10884 - RNA, 23 nt, Homo sapiens
agagaagcuggagguuucugguc

SEQ ID NO: 10885 - RNA, 23 nt, Homo sapiens
gagaagcuggagguuucuggucc

SEQ ID NO: 10886 - RNA, 23 nt, Homo sapiens
agaagcuggagguuucuggucca

SEQ ID NO: 10887 - RNA, 23 nt, Homo sapiens
gaagcuggagguuucugguccag

SEQ ID NO: 10888 - RNA, 23 nt, Homo sapiens
aagcuggagguuucugguccagg

SEQ ID NO: 10889 - RNA, 23 nt, Homo sapiens
agcuggagguuucugguccagga

SEQ ID NO: 10890 - RNA, 23 nt, Homo sapiens
gcuggagguuucugguccaggag

SEQ ID NO: 10891 - RNA, 23 nt, Homo sapiens
cuggagguuucugguccaggagg

SEQ ID NO: 10892 - RNA, 23 nt, Homo sapiens
uggagguuucugguccaggaggc

SEQ ID NO: 10893 - RNA, 23 nt, Homo sapiens
ggagguuucugguccaggaggcu

SEQ ID NO: 10894 - RNA, 23 nt, Homo sapiens
gagguuucugguccaggaggcug

SEQ ID NO: 10895 - RNA, 23 nt, Homo sapiens
agguuucugguccaggaggcugc

SEQ ID NO: 10896 - RNA, 23 nt, Homo sapiens
gguuucugguccaggaggcugca

SEQ ID NO: 10897 - RNA, 23 nt, Homo sapiens
guuucugguccaggaggcugcaa

SEQ ID NO: 10898 - RNA, 23 nt, Homo sapiens
uuucugguccaggaggcugcaau

SEQ ID NO: 10899 - RNA, 23 nt, Homo sapiens
uucugguccaggaggcugcaauc

SEQ ID NO: 10900 - RNA, 23 nt, Homo sapiens
ucugguccaggaggcugcaaucu

SEQ ID NO: 10901 - RNA, 23 nt, Homo sapiens
cugguccaggaggcugcaaucug

SEQ ID NO: 10902 - RNA, 23 nt, Homo sapiens
ugguccaggaggcugcaaucugg

SEQ ID NO: 10903 - RNA, 23 nt, Homo sapiens
gguccaggaggcugcaaucugga

SEQ ID NO: 10904 - RNA, 23 nt, Homo sapiens
guccaggaggcugcaaucuggag

SEQ ID NO: 10905 - RNA, 23 nt, Homo sapiens
uccaggaggcugcaaucuggagc

SEQ ID NO: 10906 - RNA, 23 nt, Homo sapiens
ccaggaggcugcaaucuggagcc

SEQ ID NO: 10907 - RNA, 23 nt, Homo sapiens
caggaggcugcaaucuggagcca

SEQ ID NO: 10908 - RNA, 23 nt, Homo sapiens
aggaggcugcaaucuggagccac

SEQ ID NO: 10909 - RNA, 23 nt, Homo sapiens
ggaggcugcaaucuggagccaca

SEQ ID NO: 10910 - RNA, 23 nt, Homo sapiens
gaggcugcaaucuggagccacau

SEQ ID NO: 10911 - RNA, 23 nt, Homo sapiens
aggcugcaaucuggagccacaug

SEQ ID NO: 10912 - RNA, 23 nt, Homo sapiens
ggcugcaaucuggagccacaugg

SEQ ID NO: 10913 - RNA, 23 nt, Homo sapiens
gcugcaaucuggagccacauggg

SEQ ID NO: 10914 - RNA, 23 nt, Homo sapiens
cugcaaucuggagccacaugggu

SEQ ID NO: 10915 - RNA, 23 nt, Homo sapiens
ugcaaucuggagccacauggguu

SEQ ID NO: 10916 - RNA, 23 nt, Homo sapiens
gcaaucuggagccacauggguuu

SEQ ID NO: 10917 - RNA, 23 nt, Homo sapiens
caaucuggagccacauggguuuu

SEQ ID NO: 10918 - RNA, 23 nt, Homo sapiens
aaucuggagccacauggguuuug

SEQ ID NO: 10919 - RNA, 23 nt, Homo sapiens
aucuggagccacauggguuuugg

SEQ ID NO: 10920 - RNA, 23 nt, Homo sapiens
ucuggagccacauggguuuuggg

SEQ ID NO: 10921 - RNA, 23 nt, Homo sapiens
cuggagccacauggguuuuggga

SEQ ID NO: 10922 - RNA, 23 nt, Homo sapiens
uggagccacauggguuuugggac

SEQ ID NO: 10923 - RNA, 23 nt, Homo sapiens
ggagccacauggguuuugggacu

SEQ ID NO: 10924 - RNA, 23 nt, Homo sapiens
gagccacauggguuuugggacug

SEQ ID NO: 10925 - RNA, 23 nt, Homo sapiens
agccacauggguuuugggacugg

SEQ ID NO: 10926 - RNA, 23 nt, Homo sapiens
gccacauggguuuugggacugga

SEQ ID NO: 10927 - RNA, 23 nt, Homo sapiens
ccacauggguuuugggacuggau

SEQ ID NO: 10928 - RNA, 23 nt, Homo sapiens
cacauggguuuugggacuggaug

SEQ ID NO: 10929 - RNA, 23 nt, Homo sapiens
acauggguuuugggacuggauga

SEQ ID NO: 10930 - RNA, 23 nt, Homo sapiens
cauggguuuugggacuggaugaa

SEQ ID NO: 10931 - RNA, 23 nt, Homo sapiens
auggguuuugggacuggaugaag

SEQ ID NO: 10932 - RNA, 23 nt, Homo sapiens
uggguuuugggacuggaugaagu

SEQ ID NO: 10933 - RNA, 23 nt, Homo sapiens
ggguuuugggacuggaugaagug

SEQ ID NO: 10934 - RNA, 23 nt, Homo sapiens
gguuuugggacuggaugaagugu

SEQ ID NO: 10935 - RNA, 23 nt, Homo sapiens
guuuugggacuggaugaaguguu

SEQ ID NO: 10936 - RNA, 23 nt, Homo sapiens
uuuugggacuggaugaaguguuu

SEQ ID NO: 10937 - RNA, 23 nt, Homo sapiens
uuugggacuggaugaaguguuuu

SEQ ID NO: 10938 - RNA, 23 nt, Homo sapiens
uugggacuggaugaaguguuuug

SEQ ID NO: 10939 - RNA, 23 nt, Homo sapiens
ugggacuggaugaaguguuuugg

SEQ ID NO: 10940 - RNA, 23 nt, Homo sapiens
gggacuggaugaaguguuuugga

SEQ ID NO: 10941 - RNA, 23 nt, Homo sapiens
ggacuggaugaaguguuuuggac

SEQ ID NO: 10942 - RNA, 23 nt, Homo sapiens
gacuggaugaaguguuuuggacg

SEQ ID NO: 10943 - RNA, 23 nt, Homo sapiens
acuggaugaaguguuuuggacgu

SEQ ID NO: 10944 - RNA, 23 nt, Homo sapiens
cuggaugaaguguuuuggacguu

SEQ ID NO: 10945 - RNA, 23 nt, Homo sapiens
uggaugaaguguuuuggacguuc

SEQ ID NO: 10946 - RNA, 23 nt, Homo sapiens
ggaugaaguguuuuggacguucg

SEQ ID NO: 10947 - RNA, 23 nt, Homo sapiens
gaugaaguguuuuggacguucgu

SEQ ID NO: 10948 - RNA, 23 nt, Homo sapiens
augaaguguuuuggacguucgua

SEQ ID NO: 10949 - RNA, 23 nt, Homo sapiens
ugaaguguuuuggacguucguag

SEQ ID NO: 10950 - RNA, 23 nt, Homo sapiens
gaaguguuuuggacguucguagu

SEQ ID NO: 10951 - RNA, 23 nt, Homo sapiens
aaguguuuuggacguucguaguu

SEQ ID NO: 10952 - RNA, 23 nt, Homo sapiens
aguguuuuggacguucguaguua

SEQ ID NO: 10953 - RNA, 23 nt, Homo sapiens
guguuuuggacguucguaguuaa

SEQ ID NO: 10954 - RNA, 23 nt, Homo sapiens
uguuuuggacguucguaguuaaa

SEQ ID NO: 10955 - RNA, 23 nt, Homo sapiens
guuuuggacguucguaguuaaac

SEQ ID NO: 10956 - RNA, 23 nt, Homo sapiens
uuuuggacguucguaguuaaaca

SEQ ID NO: 10957 - RNA, 23 nt, Homo sapiens
uuuggacguucguaguuaaacau

SEQ ID NO: 10958 - RNA, 23 nt, Homo sapiens
uuggacguucguaguuaaacaug

SEQ ID NO: 10959 - RNA, 23 nt, Homo sapiens
uggacguucguaguuaaacaugc

SEQ ID NO: 10960 - RNA, 23 nt, Homo sapiens
ggacguucguaguuaaacaugcu

SEQ ID NO: 10961 - RNA, 23 nt, Homo sapiens
gacguucguaguuaaacaugcuu

SEQ ID NO: 10962 - RNA, 23 nt, Homo sapiens
acguucguaguuaaacaugcuua

SEQ ID NO: 10963 - RNA, 23 nt, Homo sapiens
cguucguaguuaaacaugcuuag

SEQ ID NO: 10964 - RNA, 23 nt, Homo sapiens
guucguaguuaaacaugcuuagu

SEQ ID NO: 10965 - RNA, 23 nt, Homo sapiens
uucguaguuaaacaugcuuaguu

SEQ ID NO: 10966 - RNA, 23 nt, Homo sapiens
ucguaguuaaacaugcuuaguug

SEQ ID NO: 10967 - RNA, 23 nt, Homo sapiens
cguaguuaaacaugcuuaguugg

SEQ ID NO: 10968 - RNA, 23 nt, Homo sapiens
guaguuaaacaugcuuaguuggu

SEQ ID NO: 10969 - RNA, 23 nt, Homo sapiens
uaguuaaacaugcuuaguuggua

SEQ ID NO: 10970 - RNA, 23 nt, Homo sapiens
aguuaaacaugcuuaguugguau

SEQ ID NO: 10971 - RNA, 23 nt, Homo sapiens
guuaaacaugcuuaguugguaua

SEQ ID NO: 10972 - RNA, 23 nt, Homo sapiens
uuaaacaugcuuaguugguauau

SEQ ID NO: 10973 - RNA, 23 nt, Homo sapiens
uaaacaugcuuaguugguauaug

SEQ ID NO: 10974 - RNA, 23 nt, Homo sapiens
aaacaugcuuaguugguauaugg

SEQ ID NO: 10975 - RNA, 23 nt, Homo sapiens
aacaugcuuaguugguauaugga

SEQ ID NO: 10976 - RNA, 23 nt, Homo sapiens
acaugcuuaguugguauauggaa

SEQ ID NO: 10977 - RNA, 23 nt, Homo sapiens
caugcuuaguugguauauggaag

SEQ ID NO: 10978 - RNA, 23 nt, Homo sapiens
augcuuaguugguauauggaaga

SEQ ID NO: 10979 - RNA, 23 nt, Homo sapiens
ugcuuaguugguauauggaagau

SEQ ID NO: 10980 - RNA, 23 nt, Homo sapiens
gcuuaguugguauauggaagaug

SEQ ID NO: 10981 - RNA, 23 nt, Homo sapiens
cuuaguugguauauggaagauga

SEQ ID NO: 10982 - RNA, 23 nt, Homo sapiens
uuaguugguauauggaagaugaa

SEQ ID NO: 10983 - RNA, 23 nt, Homo sapiens
uaguugguauauggaagaugaag

SEQ ID NO: 10984 - RNA, 23 nt, Homo sapiens
aguugguauauggaagaugaagg

SEQ ID NO: 10985 - RNA, 23 nt, Homo sapiens
guugguauauggaagaugaaggc

SEQ ID NO: 10986 - RNA, 23 nt, Homo sapiens
uugguauauggaagaugaaggca

SEQ ID NO: 10987 - RNA, 23 nt, Homo sapiens
ugguauauggaagaugaaggcaa

SEQ ID NO: 10988 - RNA, 23 nt, Homo sapiens
gguauauggaagaugaaggcaaa

SEQ ID NO: 10989 - RNA, 23 nt, Homo sapiens
guauauggaagaugaaggcaaau

SEQ ID NO: 10990 - RNA, 23 nt, Homo sapiens
uauauggaagaugaaggcaaauu

SEQ ID NO: 10991 - RNA, 23 nt, Homo sapiens
auauggaagaugaaggcaaauua

SEQ ID NO: 10992 - RNA, 23 nt, Homo sapiens
uauggaagaugaaggcaaauuau

SEQ ID NO: 10993 - RNA, 23 nt, Homo sapiens
auggaagaugaaggcaaauuauu

SEQ ID NO: 10994 - RNA, 23 nt, Homo sapiens
uggaagaugaaggcaaauuauua

SEQ ID NO: 10995 - RNA, 23 nt, Homo sapiens
ggaagaugaaggcaaauuauuac

SEQ ID NO: 10996 - RNA, 23 nt, Homo sapiens
gaagaugaaggcaaauuauuacu

SEQ ID NO: 10997 - RNA, 23 nt, Homo sapiens
aagaugaaggcaaauuauuacua

SEQ ID NO: 10998 - RNA, 23 nt, Homo sapiens
agaugaaggcaaauuauuacuau

SEQ ID NO: 10999 - RNA, 23 nt, Homo sapiens
gaugaaggcaaauuauuacuaua

SEQ ID NO: 11000 - RNA, 23 nt, Homo sapiens
augaaggcaaauuauuacuauaa

SEQ ID NO: 11001 - RNA, 23 nt, Homo sapiens
ugaaggcaaauuauuacuauaau

SEQ ID NO: 11002 - RNA, 23 nt, Homo sapiens
gaaggcaaauuauuacuauaaug

SEQ ID NO: 11003 - RNA, 23 nt, Homo sapiens
aaggcaaauuauuacuauaauga

SEQ ID NO: 11004 - RNA, 23 nt, Homo sapiens
aggcaaauuauuacuauaaugau

SEQ ID NO: 11005 - RNA, 23 nt, Homo sapiens
ggcaaauuauuacuauaaugauu

SEQ ID NO: 11006 - RNA, 23 nt, Homo sapiens
gcaaauuauuacuauaaugauuu

SEQ ID NO: 11007 - RNA, 23 nt, Homo sapiens
caaauuauuacuauaaugauuug

SEQ ID NO: 11008 - RNA, 23 nt, Homo sapiens
aaauuauuacuauaaugauuugu

SEQ ID NO: 11009 - RNA, 23 nt, Homo sapiens
aauuauuacuauaaugauuuguu

SEQ ID NO: 11010 - RNA, 23 nt, Homo sapiens
auuauuacuauaaugauuuguuc

SEQ ID NO: 11011 - RNA, 23 nt, Homo sapiens
uuauuacuauaaugauuuguucc

SEQ ID NO: 11012 - RNA, 23 nt, Homo sapiens
uauuacuauaaugauuuguuccu

SEQ ID NO: 11013 - RNA, 23 nt, Homo sapiens
auuacuauaaugauuuguuccug

SEQ ID NO: 11014 - RNA, 23 nt, Homo sapiens
uuacuauaaugauuuguuccugg

SEQ ID NO: 11015 - RNA, 23 nt, Homo sapiens
uacuauaaugauuuguuccugga

SEQ ID NO: 11016 - RNA, 23 nt, Homo sapiens
acuauaaugauuuguuccuggaa

SEQ ID NO: 11017 - RNA, 23 nt, Homo sapiens
cuauaaugauuuguuccuggaag

SEQ ID NO: 11018 - RNA, 23 nt, Homo sapiens
uauaaugauuuguuccuggaagg

SEQ ID NO: 11019 - RNA, 23 nt, Homo sapiens
auaaugauuuguuccuggaaggg

SEQ ID NO: 11020 - RNA, 23 nt, Homo sapiens
uaaugauuuguuccuggaagggu

SEQ ID NO: 11021 - RNA, 23 nt, Homo sapiens
aaugauuuguuccuggaagggug

SEQ ID NO: 11022 - RNA, 23 nt, Homo sapiens
augauuuguuccuggaagggugg

SEQ ID NO: 11023 - RNA, 23 nt, Homo sapiens
ugauuuguuccuggaaggguggg

SEQ ID NO: 11024 - RNA, 23 nt, Homo sapiens
gauuuguuccuggaagggugggg

SEQ ID NO: 11025 - RNA, 23 nt, Homo sapiens
auuuguuccuggaaggguggggc

SEQ ID NO: 11026 - RNA, 23 nt, Homo sapiens
uuuguuccuggaaggguggggcc

SEQ ID NO: 11027 - RNA, 23 nt, Homo sapiens
uuguuccuggaaggguggggccc

SEQ ID NO: 11028 - RNA, 23 nt, Homo sapiens
uguuccuggaaggguggggcccu

SEQ ID NO: 11029 - RNA, 23 nt, Homo sapiens
guuccuggaaggguggggcccug

SEQ ID NO: 11030 - RNA, 23 nt, Homo sapiens
uuccuggaaggguggggcccuga

SEQ ID NO: 11031 - RNA, 23 nt, Homo sapiens
uccuggaaggguggggcccugaa

SEQ ID NO: 11032 - RNA, 23 nt, Homo sapiens
ccuggaaggguggggcccugaau

SEQ ID NO: 11033 - RNA, 23 nt, Homo sapiens
cuggaaggguggggcccugaauu

SEQ ID NO: 11034 - RNA, 23 nt, Homo sapiens
uggaaggguggggcccugaauuu

SEQ ID NO: 11035 - RNA, 23 nt, Homo sapiens
ggaaggguggggcccugaauuug

SEQ ID NO: 11036 - RNA, 23 nt, Homo sapiens
gaaggguggggcccugaauuugg

SEQ ID NO: 11037 - RNA, 23 nt, Homo sapiens
aaggguggggcccugaauuuggg

SEQ ID NO: 11038 - RNA, 23 nt, Homo sapiens
aggguggggcccugaauuugggg

SEQ ID NO: 11039 - RNA, 23 nt, Homo sapiens
ggguggggcccugaauuuggggc

SEQ ID NO: 11040 - RNA, 23 nt, Homo sapiens
gguggggcccugaauuuggggcc

SEQ ID NO: 11041 - RNA, 23 nt, Homo sapiens
guggggcccugaauuuggggcca

SEQ ID NO: 11042 - RNA, 23 nt, Homo sapiens
uggggcccugaauuuggggccac

SEQ ID NO: 11043 - RNA, 23 nt, Homo sapiens
ggggcccugaauuuggggccaca

SEQ ID NO: 11044 - RNA, 23 nt, Homo sapiens
gggcccugaauuuggggccacaa

SEQ ID NO: 11045 - RNA, 23 nt, Homo sapiens
ggcccugaauuuggggccacaag

SEQ ID NO: 11046 - RNA, 23 nt, Homo sapiens
gcccugaauuuggggccacaagc

SEQ ID NO: 11047 - RNA, 23 nt, Homo sapiens
cccugaauuuggggccacaagcc

SEQ ID NO: 11048 - RNA, 23 nt, Homo sapiens
ccugaauuuggggccacaagccu

SEQ ID NO: 11049 - RNA, 23 nt, Homo sapiens
cugaauuuggggccacaagccug

SEQ ID NO: 11050 - RNA, 23 nt, Homo sapiens
ugaauuuggggccacaagccugg

SEQ ID NO: 11051 - RNA, 23 nt, Homo sapiens
gaauuuggggccacaagccugga

SEQ ID NO: 11052 - RNA, 23 nt, Homo sapiens
aauuuggggccacaagccuggaa

SEQ ID NO: 11053 - RNA, 23 nt, Homo sapiens
auuuggggccacaagccuggaau

SEQ ID NO: 11054 - RNA, 23 nt, Homo sapiens
uuuggggccacaagccuggaauu

SEQ ID NO: 11055 - RNA, 23 nt, Homo sapiens
uuggggccacaagccuggaauua

SEQ ID NO: 11056 - RNA, 23 nt, Homo sapiens
uggggccacaagccuggaauuac

SEQ ID NO: 11057 - RNA, 23 nt, Homo sapiens
ggggccacaagccuggaauuacg

SEQ ID NO: 11058 - RNA, 23 nt, Homo sapiens
gggccacaagccuggaauuacgg

SEQ ID NO: 11059 - RNA, 23 nt, Homo sapiens
ggccacaagccuggaauuacgga

SEQ ID NO: 11060 - RNA, 23 nt, Homo sapiens
gccacaagccuggaauuacggaa

SEQ ID NO: 11061 - RNA, 23 nt, Homo sapiens
ccacaagccuggaauuacggaag

SEQ ID NO: 11062 - RNA, 23 nt, Homo sapiens
cacaagccuggaauuacggaagg

SEQ ID NO: 11063 - RNA, 23 nt, Homo sapiens
acaagccuggaauuacggaaggu

SEQ ID NO: 11064 - RNA, 23 nt, Homo sapiens
caagccuggaauuacggaagguu

SEQ ID NO: 11065 - RNA, 23 nt, Homo sapiens
aagccuggaauuacggaagguug

SEQ ID NO: 11066 - RNA, 23 nt, Homo sapiens
agccuggaauuacggaagguugu

SEQ ID NO: 11067 - RNA, 23 nt, Homo sapiens
gccuggaauuacggaagguugua

SEQ ID NO: 11068 - RNA, 23 nt, Homo sapiens
ccuggaauuacggaagguuguaa

SEQ ID NO: 11069 - RNA, 23 nt, Homo sapiens
cuggaauuacggaagguuguaag

SEQ ID NO: 11070 - RNA, 23 nt, Homo sapiens
uggaauuacggaagguuguaagg

SEQ ID NO: 11071 - RNA, 23 nt, Homo sapiens
ggaauuacggaagguuguaagga

SEQ ID NO: 11072 - RNA, 23 nt, Homo sapiens
gaauuacggaagguuguaaggaa

SEQ ID NO: 11073 - RNA, 23 nt, Homo sapiens
aauuacggaagguuguaaggaau

SEQ ID NO: 11074 - RNA, 23 nt, Homo sapiens
auuacggaagguuguaaggaauc

SEQ ID NO: 11075 - RNA, 23 nt, Homo sapiens
uuacggaagguuguaaggaauca

SEQ ID NO: 11076 - RNA, 23 nt, Homo sapiens
uacggaagguuguaaggaaucag

SEQ ID NO: 11077 - RNA, 23 nt, Homo sapiens
acggaagguuguaaggaaucaga

SEQ ID NO: 11078 - RNA, 23 nt, Homo sapiens
cggaagguuguaaggaaucagaa

SEQ ID NO: 11079 - RNA, 23 nt, Homo sapiens
ggaagguuguaaggaaucagaag

SEQ ID NO: 11080 - RNA, 23 nt, Homo sapiens
gaagguuguaaggaaucagaagc

SEQ ID NO: 11081 - RNA, 23 nt, Homo sapiens
aagguuguaaggaaucagaagca

SEQ ID NO: 11082 - RNA, 23 nt, Homo sapiens
agguuguaaggaaucagaagcaa

SEQ ID NO: 11083 - RNA, 23 nt, Homo sapiens
gguuguaaggaaucagaagcaac

SEQ ID NO: 11084 - RNA, 23 nt, Homo sapiens
guuguaaggaaucagaagcaacc

SEQ ID NO: 11085 - RNA, 23 nt, Homo sapiens
uuguaaggaaucagaagcaaccu

SEQ ID NO: 11086 - RNA, 23 nt, Homo sapiens
uguaaggaaucagaagcaaccuu

SEQ ID NO: 11087 - RNA, 23 nt, Homo sapiens
guaaggaaucagaagcaaccuug

SEQ ID NO: 11088 - RNA, 23 nt, Homo sapiens
uaaggaaucagaagcaaccuugg

SEQ ID NO: 11089 - RNA, 23 nt, Homo sapiens
aaggaaucagaagcaaccuuggu

SEQ ID NO: 11090 - RNA, 23 nt, Homo sapiens
aggaaucagaagcaaccuugguc

SEQ ID NO: 11091 - RNA, 23 nt, Homo sapiens
ggaaucagaagcaaccuuggucu

SEQ ID NO: 11092 - RNA, 23 nt, Homo sapiens
gaaucagaagcaaccuuggucug

SEQ ID NO: 11093 - RNA, 23 nt, Homo sapiens
aaucagaagcaaccuuggucugc

SEQ ID NO: 11094 - RNA, 23 nt, Homo sapiens
aucagaagcaaccuuggucugcu

SEQ ID NO: 11095 - RNA, 23 nt, Homo sapiens
ucagaagcaaccuuggucugcuc

SEQ ID NO: 11096 - RNA, 23 nt, Homo sapiens
cagaagcaaccuuggucugcucu

SEQ ID NO: 11097 - RNA, 23 nt, Homo sapiens
agaagcaaccuuggucugcucuu

SEQ ID NO: 11098 - RNA, 23 nt, Homo sapiens
gaagcaaccuuggucugcucuuc

SEQ ID NO: 11099 - RNA, 23 nt, Homo sapiens
aagcaaccuuggucugcucuucc

SEQ ID NO: 11100 - RNA, 23 nt, Homo sapiens
agcaaccuuggucugcucuuccu

SEQ ID NO: 11101 - RNA, 23 nt, Homo sapiens
gcaaccuuggucugcucuuccuu

SEQ ID NO: 11102 - RNA, 23 nt, Homo sapiens
caaccuuggucugcucuuccuug

SEQ ID NO: 11103 - RNA, 23 nt, Homo sapiens
aaccuuggucugcucuuccuugu

SEQ ID NO: 11104 - RNA, 23 nt, Homo sapiens
accuuggucugcucuuccuuguu

SEQ ID NO: 11105 - RNA, 23 nt, Homo sapiens
ccuuggucugcucuuccuuguug

SEQ ID NO: 11106 - RNA, 23 nt, Homo sapiens
cuuggucugcucuuccuuguuga

SEQ ID NO: 11107 - RNA, 23 nt, Homo sapiens
uuggucugcucuuccuuguugag

SEQ ID NO: 11108 - RNA, 23 nt, Homo sapiens
uggucugcucuuccuuguugaga

SEQ ID NO: 11109 - RNA, 23 nt, Homo sapiens
ggucugcucuuccuuguugagau

SEQ ID NO: 11110 - RNA, 23 nt, Homo sapiens
gucugcucuuccuuguugagauc

SEQ ID NO: 11111 - RNA, 23 nt, Homo sapiens
ucugcucuuccuuguugagaucc

SEQ ID NO: 11112 - RNA, 23 nt, Homo sapiens
cugcucuuccuuguugagauccu

SEQ ID NO: 11113 - RNA, 23 nt, Homo sapiens
ugcucuuccuuguugagauccug

SEQ ID NO: 11114 - RNA, 23 nt, Homo sapiens
gcucuuccuuguugagauccuga

SEQ ID NO: 11115 - RNA, 23 nt, Homo sapiens
cucuuccuuguugagauccugag

SEQ ID NO: 11116 - RNA, 23 nt, Homo sapiens
ucuuccuuguugagauccugaga

SEQ ID NO: 11117 - RNA, 23 nt, Homo sapiens
cuuccuuguugagauccugagaa

SEQ ID NO: 11118 - RNA, 23 nt, Homo sapiens
uuccuuguugagauccugagaau

SEQ ID NO: 11119 - RNA, 23 nt, Homo sapiens
uccuuguugagauccugagaaua

SEQ ID NO: 11120 - RNA, 23 nt, Homo sapiens
ccuuguugagauccugagaauac

SEQ ID NO: 11121 - RNA, 23 nt, Homo sapiens
cuuguugagauccugagaauacu

SEQ ID NO: 11122 - RNA, 23 nt, Homo sapiens
uuguugagauccugagaauacug

SEQ ID NO: 11123 - RNA, 23 nt, Homo sapiens
uguugagauccugagaauacugu

SEQ ID NO: 11124 - RNA, 23 nt, Homo sapiens
guugagauccugagaauacugug

SEQ ID NO: 11125 - RNA, 23 nt, Homo sapiens
uugagauccugagaauacugugc

SEQ ID NO: 11126 - RNA, 23 nt, Homo sapiens
ugagauccugagaauacugugcu

SEQ ID NO: 11127 - RNA, 23 nt, Homo sapiens
gagauccugagaauacugugcuc

SEQ ID NO: 11128 - RNA, 23 nt, Homo sapiens
agauccugagaauacugugcucc

SEQ ID NO: 11129 - RNA, 23 nt, Homo sapiens
gauccugagaauacugugcuccu

SEQ ID NO: 11130 - RNA, 23 nt, Homo sapiens
auccugagaauacugugcuccug

SEQ ID NO: 11131 - RNA, 23 nt, Homo sapiens
uccugagaauacugugcuccugg

SEQ ID NO: 11132 - RNA, 23 nt, Homo sapiens
ccugagaauacugugcuccuggc

SEQ ID NO: 11133 - RNA, 23 nt, Homo sapiens
cugagaauacugugcuccuggcu

SEQ ID NO: 11134 - RNA, 23 nt, Homo sapiens
ugagaauacugugcuccuggcuu

SEQ ID NO: 11135 - RNA, 23 nt, Homo sapiens
gagaauacugugcuccuggcuuu

SEQ ID NO: 11136 - RNA, 23 nt, Homo sapiens
agaauacugugcuccuggcuuug

SEQ ID NO: 11137 - RNA, 23 nt, Homo sapiens
gaauacugugcuccuggcuuugg

SEQ ID NO: 11138 - RNA, 23 nt, Homo sapiens
aauacugugcuccuggcuuuggu

SEQ ID NO: 11139 - RNA, 23 nt, Homo sapiens
auacugugcuccuggcuuuggua

SEQ ID NO: 11140 - RNA, 23 nt, Homo sapiens
uacugugcuccuggcuuugguag

SEQ ID NO: 11141 - RNA, 23 nt, Homo sapiens
acugugcuccuggcuuugguaga

SEQ ID NO: 11142 - RNA, 23 nt, Homo sapiens
cugugcuccuggcuuugguagag

SEQ ID NO: 11143 - RNA, 23 nt, Homo sapiens
ugugcuccuggcuuugguagagu

SEQ ID NO: 11144 - RNA, 23 nt, Homo sapiens
gugcuccuggcuuugguagagug

SEQ ID NO: 11145 - RNA, 23 nt, Homo sapiens
ugcuccuggcuuugguagaguga

SEQ ID NO: 11146 - RNA, 23 nt, Homo sapiens
gcuccuggcuuugguagagugac

SEQ ID NO: 11147 - RNA, 23 nt, Homo sapiens
cuccuggcuuugguagagugacc

SEQ ID NO: 11148 - RNA, 23 nt, Homo sapiens
uccuggcuuugguagagugaccu

SEQ ID NO: 11149 - RNA, 23 nt, Homo sapiens
ccuggcuuugguagagugaccuu

SEQ ID NO: 11150 - RNA, 23 nt, Homo sapiens
cuggcuuugguagagugaccuuc

SEQ ID NO: 11151 - RNA, 23 nt, Homo sapiens
uggcuuugguagagugaccuucu

SEQ ID NO: 11152 - RNA, 23 nt, Homo sapiens
ggcuuugguagagugaccuucuc

SEQ ID NO: 11153 - RNA, 23 nt, Homo sapiens
gcuuugguagagugaccuucucu

SEQ ID NO: 11154 - RNA, 23 nt, Homo sapiens
cuuugguagagugaccuucucuu

SEQ ID NO: 11155 - RNA, 23 nt, Homo sapiens
uuugguagagugaccuucucuug

SEQ ID NO: 11156 - RNA, 23 nt, Homo sapiens
uugguagagugaccuucucuuga

SEQ ID NO: 11157 - RNA, 23 nt, Homo sapiens
ugguagagugaccuucucuugaa

SEQ ID NO: 11158 - RNA, 23 nt, Homo sapiens
gguagagugaccuucucuugaag

SEQ ID NO: 11159 - RNA, 23 nt, Homo sapiens
guagagugaccuucucuugaaga

SEQ ID NO: 11160 - RNA, 23 nt, Homo sapiens
uagagugaccuucucuugaagaa

SEQ ID NO: 11161 - RNA, 23 nt, Homo sapiens
agagugaccuucucuugaagaau

SEQ ID NO: 11162 - RNA, 23 nt, Homo sapiens
gagugaccuucucuugaagaaua

SEQ ID NO: 11163 - RNA, 23 nt, Homo sapiens
agugaccuucucuugaagaauau

SEQ ID NO: 11164 - RNA, 23 nt, Homo sapiens
gugaccuucucuugaagaauauu

SEQ ID NO: 11165 - RNA, 23 nt, Homo sapiens
ugaccuucucuugaagaauauug

SEQ ID NO: 11166 - RNA, 23 nt, Homo sapiens
gaccuucucuugaagaauauugu

SEQ ID NO: 11167 - RNA, 23 nt, Homo sapiens
accuucucuugaagaauauuguu

SEQ ID NO: 11168 - RNA, 23 nt, Homo sapiens
ccuucucuugaagaauauuguuc

SEQ ID NO: 11169 - RNA, 23 nt, Homo sapiens
cuucucuugaagaauauuguucc

SEQ ID NO: 11170 - RNA, 23 nt, Homo sapiens
uucucuugaagaauauuguuccc

SEQ ID NO: 11171 - RNA, 23 nt, Homo sapiens
ucucuugaagaauauuguucccg

SEQ ID NO: 11172 - RNA, 23 nt, Homo sapiens
cucuugaagaauauuguucccgu

SEQ ID NO: 11173 - RNA, 23 nt, Homo sapiens
ucuugaagaauauuguucccgua

SEQ ID NO: 11174 - RNA, 23 nt, Homo sapiens
cuugaagaauauuguucccguag

SEQ ID NO: 11175 - RNA, 23 nt, Homo sapiens
uugaagaauauuguucccguagu

SEQ ID NO: 11176 - RNA, 23 nt, Homo sapiens
ugaagaauauuguucccguaguu

SEQ ID NO: 11177 - RNA, 23 nt, Homo sapiens
gaagaauauuguucccguaguuc

SEQ ID NO: 11178 - RNA, 23 nt, Homo sapiens
aagaauauuguucccguaguucc

SEQ ID NO: 11179 - RNA, 23 nt, Homo sapiens
agaauauuguucccguaguucca

SEQ ID NO: 11180 - RNA, 23 nt, Homo sapiens
gaauauuguucccguaguuccag

SEQ ID NO: 11181 - RNA, 23 nt, Homo sapiens
aauauuguucccguaguuccaga

SEQ ID NO: 11182 - RNA, 23 nt, Homo sapiens
auauuguucccguaguuccagag

SEQ ID NO: 11183 - RNA, 23 nt, Homo sapiens
uauuguucccguaguuccagagg

SEQ ID NO: 11184 - RNA, 23 nt, Homo sapiens
auuguucccguaguuccagaggg

SEQ ID NO: 11185 - RNA, 23 nt, Homo sapiens
uuguucccguaguuccagagggu

SEQ ID NO: 11186 - RNA, 23 nt, Homo sapiens
uguucccguaguuccagagggug

SEQ ID NO: 11187 - RNA, 23 nt, Homo sapiens
guucccguaguuccagagggugc

SEQ ID NO: 11188 - RNA, 23 nt, Homo sapiens
uucccguaguuccagagggugcc

SEQ ID NO: 11189 - RNA, 23 nt, Homo sapiens
ucccguaguuccagagggugcca

SEQ ID NO: 11190 - RNA, 23 nt, Homo sapiens
cccguaguuccagagggugccag

SEQ ID NO: 11191 - RNA, 23 nt, Homo sapiens
ccguaguuccagagggugccagc

SEQ ID NO: 11192 - RNA, 23 nt, Homo sapiens
cguaguuccagagggugccagcu

SEQ ID NO: 11193 - RNA, 23 nt, Homo sapiens
guaguuccagagggugccagcug

SEQ ID NO: 11194 - RNA, 23 nt, Homo sapiens
uaguuccagagggugccagcugg

SEQ ID NO: 11195 - RNA, 23 nt, Homo sapiens
aguuccagagggugccagcuggg

SEQ ID NO: 11196 - RNA, 23 nt, Homo sapiens
guuccagagggugccagcugggu

SEQ ID NO: 11197 - RNA, 23 nt, Homo sapiens
uuccagagggugccagcuggguu

SEQ ID NO: 11198 - RNA, 23 nt, Homo sapiens
uccagagggugccagcuggguuu

SEQ ID NO: 11199 - RNA, 23 nt, Homo sapiens
ccagagggugccagcuggguuua

SEQ ID NO: 11200 - RNA, 23 nt, Homo sapiens
cagagggugccagcuggguuuaa

SEQ ID NO: 11201 - RNA, 23 nt, Homo sapiens
agagggugccagcuggguuuaac

SEQ ID NO: 11202 - RNA, 23 nt, Homo sapiens
gagggugccagcuggguuuaacc

SEQ ID NO: 11203 - RNA, 23 nt, Homo sapiens
agggugccagcuggguuuaaccc

SEQ ID NO: 11204 - RNA, 23 nt, Homo sapiens
gggugccagcuggguuuaaccca

SEQ ID NO: 11205 - RNA, 23 nt, Homo sapiens
ggugccagcuggguuuaacccac

SEQ ID NO: 11206 - RNA, 23 nt, Homo sapiens
gugccagcuggguuuaacccacu

SEQ ID NO: 11207 - RNA, 23 nt, Homo sapiens
ugccagcuggguuuaacccacua

SEQ ID NO: 11208 - RNA, 23 nt, Homo sapiens
gccagcuggguuuaacccacuau

SEQ ID NO: 11209 - RNA, 23 nt, Homo sapiens
ccagcuggguuuaacccacuauu

SEQ ID NO: 11210 - RNA, 23 nt, Homo sapiens
cagcuggguuuaacccacuauug

SEQ ID NO: 11211 - RNA, 23 nt, Homo sapiens
agcuggguuuaacccacuauuga

SEQ ID NO: 11212 - RNA, 23 nt, Homo sapiens
gcuggguuuaacccacuauugaa

SEQ ID NO: 11213 - RNA, 23 nt, Homo sapiens
cuggguuuaacccacuauugaag

SEQ ID NO: 11214 - RNA, 23 nt, Homo sapiens
uggguuuaacccacuauugaagg

SEQ ID NO: 11215 - RNA, 23 nt, Homo sapiens
ggguuuaacccacuauugaaggg

SEQ ID NO: 11216 - RNA, 23 nt, Homo sapiens
gguuuaacccacuauugaaggga

SEQ ID NO: 11217 - RNA, 23 nt, Homo sapiens
guuuaacccacuauugaagggaa

SEQ ID NO: 11218 - RNA, 23 nt, Homo sapiens
uuuaacccacuauugaagggaag

SEQ ID NO: 11219 - RNA, 23 nt, Homo sapiens
uuaacccacuauugaagggaagg

SEQ ID NO: 11220 - RNA, 23 nt, Homo sapiens
uaacccacuauugaagggaagga

SEQ ID NO: 11221 - RNA, 23 nt, Homo sapiens
aacccacuauugaagggaaggaa

SEQ ID NO: 11222 - RNA, 23 nt, Homo sapiens
acccacuauugaagggaaggaag

SEQ ID NO: 11223 - RNA, 23 nt, Homo sapiens
cccacuauugaagggaaggaaga

SEQ ID NO: 11224 - RNA, 23 nt, Homo sapiens
ccacuauugaagggaaggaagag

SEQ ID NO: 11225 - RNA, 23 nt, Homo sapiens
cacuauugaagggaaggaagagg

SEQ ID NO: 11226 - RNA, 23 nt, Homo sapiens
acuauugaagggaaggaagaggc

SEQ ID NO: 11227 - RNA, 23 nt, Homo sapiens
cuauugaagggaaggaagaggca

SEQ ID NO: 11228 - RNA, 23 nt, Homo sapiens
uauugaagggaaggaagaggcau

SEQ ID NO: 11229 - RNA, 23 nt, Homo sapiens
auugaagggaaggaagaggcauc

SEQ ID NO: 11230 - RNA, 23 nt, Homo sapiens
uugaagggaaggaagaggcaucu

SEQ ID NO: 11231 - RNA, 23 nt, Homo sapiens
ugaagggaaggaagaggcaucuc

SEQ ID NO: 11232 - RNA, 23 nt, Homo sapiens
gaagggaaggaagaggcaucucc

SEQ ID NO: 11233 - RNA, 23 nt, Homo sapiens
aagggaaggaagaggcaucuccu

SEQ ID NO: 11234 - RNA, 23 nt, Homo sapiens
agggaaggaagaggcaucuccuu

SEQ ID NO: 11235 - RNA, 23 nt, Homo sapiens
gggaaggaagaggcaucuccuuc

SEQ ID NO: 11236 - RNA, 23 nt, Homo sapiens
ggaaggaagaggcaucuccuucc

SEQ ID NO: 11237 - RNA, 23 nt, Homo sapiens
gaaggaagaggcaucuccuuccc

SEQ ID NO: 11238 - RNA, 23 nt, Homo sapiens
aaggaagaggcaucuccuucccu

SEQ ID NO: 11239 - RNA, 23 nt, Homo sapiens
aggaagaggcaucuccuucccuc

SEQ ID NO: 11240 - RNA, 23 nt, Homo sapiens
ggaagaggcaucuccuucccuca

SEQ ID NO: 11241 - RNA, 23 nt, Homo sapiens
gaagaggcaucuccuucccucac

SEQ ID NO: 11242 - RNA, 23 nt, Homo sapiens
aagaggcaucuccuucccucaca

SEQ ID NO: 11243 - RNA, 23 nt, Homo sapiens
agaggcaucuccuucccucacag

SEQ ID NO: 11244 - RNA, 23 nt, Homo sapiens
gaggcaucuccuucccucacaga

SEQ ID NO: 11245 - RNA, 23 nt, Homo sapiens
aggcaucuccuucccucacagac

SEQ ID NO: 11246 - RNA, 23 nt, Homo sapiens
ggcaucuccuucccucacagacu

SEQ ID NO: 11247 - RNA, 23 nt, Homo sapiens
gcaucuccuucccucacagacua

SEQ ID NO: 11248 - RNA, 23 nt, Homo sapiens
caucuccuucccucacagacuaa

SEQ ID NO: 11249 - RNA, 23 nt, Homo sapiens
aucuccuucccucacagacuaau

SEQ ID NO: 11250 - RNA, 23 nt, Homo sapiens
ucuccuucccucacagacuaauc

SEQ ID NO: 11251 - RNA, 23 nt, Homo sapiens
cuccuucccucacagacuaaucu

SEQ ID NO: 11252 - RNA, 23 nt, Homo sapiens
uccuucccucacagacuaaucua

SEQ ID NO: 11253 - RNA, 23 nt, Homo sapiens
ccuucccucacagacuaaucuag

SEQ ID NO: 11254 - RNA, 23 nt, Homo sapiens
cuucccucacagacuaaucuagu

SEQ ID NO: 11255 - RNA, 23 nt, Homo sapiens
uucccucacagacuaaucuagug

SEQ ID NO: 11256 - RNA, 23 nt, Homo sapiens
ucccucacagacuaaucuagugg

SEQ ID NO: 11257 - RNA, 23 nt, Homo sapiens
cccucacagacuaaucuaguggc

SEQ ID NO: 11258 - RNA, 23 nt, Homo sapiens
ccucacagacuaaucuaguggcu

SEQ ID NO: 11259 - RNA, 23 nt, Homo sapiens
cucacagacuaaucuaguggcuc

SEQ ID NO: 11260 - RNA, 23 nt, Homo sapiens
ucacagacuaaucuaguggcucu

SEQ ID NO: 11261 - RNA, 23 nt, Homo sapiens
cacagacuaaucuaguggcucug

SEQ ID NO: 11262 - RNA, 23 nt, Homo sapiens
acagacuaaucuaguggcucugu

SEQ ID NO: 11263 - RNA, 23 nt, Homo sapiens
cagacuaaucuaguggcucugug

SEQ ID NO: 11264 - RNA, 23 nt, Homo sapiens
agacuaaucuaguggcucugugc

SEQ ID NO: 11265 - RNA, 23 nt, Homo sapiens
gacuaaucuaguggcucugugcu

SEQ ID NO: 11266 - RNA, 23 nt, Homo sapiens
acuaaucuaguggcucugugcuu

SEQ ID NO: 11267 - DNA, 2834 bp, Homo sapiens
gggaaggagatgcctcttccttcccttcaatagtgggttaaacccagctggcaccctctggaactacgggaacaatattcttcaagagaaggtcactctaccaaagccaggagcacagtattctcaggatctcaacaaggaagagcagaccaaggttgcttctgattccttacaaccttccgtaattccaggcttgtggccccaaattcagggccccacccttccaggaacaaatcattatagtaataatttgccttcatcttccatataccaactaagcatgtttaactacgaacgtccaaaacacttcatccagtcccaaaacccatgtggctccagattgcagcctcctggaccagaaacctccagcttctctagccagaccaaacagtcttccattatcatccagccccgccagtgtacagagcaaagattttctgcctcctcaatactgagctctcacatcaccatgtcctcctctgctttccctgcttctcccaagcagcatgctggctccaacccaggccaaagggttacaaccacctataaccagtccccagccagcttcctcagctccatattaccatcacagggaaggagatgcctcttccttcccttcaatagtgggttaaacccagctggcaccctctggaactacgggaacaatattcttcaagagaaggtcactctaccaaagccaggagcacagtattctcaggatctcaacaaggaagagcagaccaaggttgcttctgattccttacaaccttccgtaattccaggcttgtggccccaaattcagggccccacccttccaggaacaaatcattatagtaataatttgccttcatcttccatataccaactaagcatgtttaactacgaacgtccaaaacacttcatccagtcccaaaacccatgtggctccagattgcagcctcctggaccagaaacctccagcttctctagccagaccaaacagtcttccattatcatccagccccgccagtgtacagagcaaagattttctgcctcctcaatactgagctctcacatcaccatgtcctcctctgctttccctgcttctcccaagcagcatgctggctccaacccaggccaaagggttacaaccacctataaccagtccccagccagcttcctcagctccatattaccatcacagcctgattacaatagcagtaaaatcccttccgctatggattccaactatcaacagtcctcagctggccaacctataaatgcaaagccatcccaaactgcaaatgctaagcccataccaagaactcctgatcatgaaatacaaggatcaaaagaagctttgattcaagatttggaaagaaagctgaaatgcaaggacacccttcttcataatggaaatcaacgtctaacatatgaagagaagatggctcgcagattgctaggaccacagaatgcagctgctgtgtttcaagctcaggatgacagtggtgcacaagactcgcagcaacacaactcagaacatgcgcgactgcaagttcctacatcacaagtaagaagtagatcaacctcaaggggagatgtgaatgatcaggatgcaatccaggagaaattttacccaccacgtttcattcaagtgccagagaacatgtcgattgatgaaggaagattctgcagaatggacttcaaagtgagtggactgccagctcctgatgtgtcatggtatctaaatggaagaacagttcaatcagatgatttgcacaaaatgatagtgtctgagaagggtcttcattcactcatctttgaagtagtcagagcttcagatgcaggggcttatgcatgtgttgccaagaatagagcaggagaagccaccttcactgtgcagctggatgtccttgcaaaagaacataaaagagcaccaatgtttatctacaaaccacagagcaaaaaagttttagagggagattcagtgaaactagaatgccagatctcggctatacctccaccaaagcttttctggaaaagaaataatgaaatggtacaattcaacactgaccgaataagcttatatcaagataacactggaagagttactttactgataaaagatgtaaacaagaaagatgctgggtggtatactgtgtcagcagttaatgaagctggagtgactacatgtaacacaagattagacgttacggcacgtccaaaccaaactcttccagctcctaagcagttacgggttcgaccaacattcagcaaatatttagcacttaatgggaaaggtttgaatgtaaaacaagcttttaacccagaaggagaatttcagcgtttggcagctcaatctggactctatgaaagtgaagaactttaataactttaccaacattggaaaacagccaactacaccattagtaatatatttgattacatttttttgaaattaatccatagctgtattaacagattatggttttaattaggtaatatagttaatatatatttataatattatttatcctttgactcttgcacattctatgtacccctccgatttgtgaagcctacaggaaatctgggtatatggatttgtaactgcagaagactatcttaaaatacaggattttaacatttaagtcatgcacatttaacaattacaggttataaattagtatcaactttttaaacacatctaatgcttgtaataacgtttactggtactgctttctaaatactgttttacccgttttctcttgtaggaatactaacatggtatagattatctgagtgttccacagttgtatgtcaaaagaaaataaaattcaaatatttaaaacgga

SEQ ID NO: 11268 - RNA, 86 nt, Artificial Sequence
  Synthetic primer
cucgagugagcgcgcaccaauguuuaucuacaaacuguaaagccacagauggguuuguagauaaacauuggugcuugccuacuaga

SEQ ID NO: 11269 - RNA, 22 nt, Artificial Sequence
  Synthetic primer
caccaauguuuaucuacaaacu

SEQ ID NO: 11270 - RNA, 22 nt, Artificial Sequence
  Synthetic primer
uuuguagauaaacauuggugcu

SEQ ID NO: 11271 - RNA, 86 nt, Artificial Sequence
  Synthetic primer
cucgagugagcgaggagauucagugaaacuagaacuguaaagccacagauggguucuaguuucacugaaucucccugccuacuaga

SEQ ID NO: 11272 - RNA, 22 nt, Artificial Sequence
  Synthetic primer
gagauucagugaaacuagaacu

SEQ ID NO: 11273 - RNA, 22 nt, Artificial Sequence
  Synthetic primer
uucuaguuucacugaaucuccc

SEQ ID NO: 11274 - DNA, 57 bp, Artificial Sequence
  Synthetic primer
aaaactcgagtgagcgacctgattacaatagcagtaaactgtaaagccacagatggg

SEQ ID NO: 11275 - DNA, 56 bp, Artificial Sequence
  Synthetic primer
ttttactagtaggcagcctgattacaatagcagtaaacccatctgtggctttacag

SEQ ID NO: 11276 - DNA, 57 bp, Artificial Sequence
  Synthetic primer
aaaactcgagtgagcgactggatgtccttgcaaaagaactgtaaagccacagatggg

SEQ ID NO: 11277 - DNA, 56 bp, Artificial Sequence
  Synthetic primer
ttttactagtaggcagctggatgtccttgcaaaagaacccatctgtggctttacag

SEQ ID NO: 11278 - DNA, 57 bp, Artificial Sequence
  Synthetic primer
aaaactcgagtgagcgcgcaccaatgtttatctacaaactgtaaagccacagatggg

SEQ ID NO: 11279 - DNA, 56 bp, Artificial Sequence
  Synthetic primer
ttttactagtaggcaagcaccaatgtttatctacaaacccatctgtggctttacag

SEQ ID NO: 11280 - DNA, 57 bp, Artificial Sequence
  Synthetic primer
aaaactcgagtgagcgaggagattcagtgaaactagaactgtaaagccacagatggg

SEQ ID NO: 11281 - DNA, 56 bp, Artificial Sequence
  Synthetic primer
ttttactagtaggcagggagattcagtgaaactagaacccatctgtggctttacag

SEQ ID NO: 11282 - DNA, 57 bp, Artificial Sequence
  Synthetic primer
aaaactcgagtgagcgcgaagagttactttactgataactgtaaagccacagatggg

SEQ ID NO: 11283 - DNA, 56 bp, Artificial Sequence
  Synthetic primer
ttttactagtaggcaggaagagttactttactgataacccatctgtggctttacag

SEQ ID NO: 11284 - DNA, 57 bp, Artificial Sequence
  Synthetic primer
aaaactcgagtgagcgagcacgtccaaaccaaactcttctgtaaagccacagatggg

SEQ ID NO: 11285 - DNA, 56 bp, Artificial Sequence
  Synthetic primer
ttttactagtaggcaggcacgtccaaaccaaactcttcccatctgtggctttacag

SEQ ID NO: 11286 - DNA, 86 bp, Artificial Sequence
  miMyoT-1043
ctcgagtgagcgatgccagagaacatgtcgattgccgtaaagccacagatgggtaatcgacatgttctctggcaccgcctactaga

SEQ ID NO: 11287 - DNA, 86 bp, Artificial Sequence
  miMyoT-1044
ctcgagtgagcgcgccagagaacatgtcgattgaccgtaaagccacagatgggttaatcgacatgttctctggcacgcctactaga

SEQ ID NO: 11288 - DNA, 86 bp, Artificial Sequence
  miMyoT-1634
ctcgagtgagcgcagcagttacgggttcgactaactgtaaagccacagatgggttggtcgaacccgtaactgcttcgcctactaga

SEQ ID NO: 11289 - DNA, 57 bp, Artificial Sequence
  Synthetic primer
aaaactcgagtgagcgatgccagagaacatgtcgattgccgtaaagccacagatggg

SEQ ID NO: 11290 - DNA, 56 bp, Artificial Sequence
  Synthetic primer
aaaaactagtaggcggtgccagagaacatgtcgattacccatctgtggctttacgg

SEQ ID NO: 11291 - DNA, 57 bp, Artificial Sequence
  Synthetic primer
aaaactcgagtgagcgcgccagagaacatgtcgattgaccgtaaagccacagatggg

SEQ ID NO: 11292 - DNA, 56 bp, Artificial Sequence
  Synthetic primer
aaaaactagtaggcgtgccagagaacatgtcgattaacccatctgtggctttacgg

SEQ ID NO: 11293 - DNA, 57 bp, Artificial Sequence
  Synthetic primer
aaaactcgagtgagcgcagcagttacgggttcgactaactgtaaagccacagatggg

SEQ ID NO: 11294 - DNA, 56 bp, Artificial Sequence
  Synthetic primer
aaaaactagtaggcgaagcagttacgggttcgaccaacccatctgtggctttacag

We claim:

1. A recombinant adeno-associated virus comprising a MYOT miRNA-encoding DNA set out in SEQ ID NO: 2, 11286, 11287 or 11288, wherein the recombinant adeno-associated virus lacks rep and cap genes.

2. A composition comprising the recombinant adeno-associated virus of claim 1 and a pharmaceutically acceptable carrier.

3. The recombinant adeno-associated virus of claim 1 wherein expression of the miRNA-encoding DNA is under the control of a CMV promoter, a muscle creatine kinase (MCK) promoter, an alpha-myosin heavy chain enhancer-/MCK enhancer-promoter (MHCK7) or a desmin promoter.

4. The recombinant adeno-associated virus of claim 1 that is a recombinant AAV-6.

5. The recombinant adeno-associated virus of claim 4 that is a self-complementary AAV-6.

6. A method of inhibiting expression of the MYOT gene in a cell comprising contacting the cell with a recombinant adeno-associated virus of claim 1, wherein the recombinant adeno-associated virus lacks rep and cap genes.

7. A method of delivering a MYOT miRNA-encoding DNA to an animal in need thereof, comprising administering to the animal a recombinant adeno-associated virus comprising the MYOT miRNA-encoding DNA set out in SEQ ID NO: 2, 11286, 11287 or 11288, wherein the recombinant adeno-associated virus lacks rep and cap genes.

8. A method of treating limb girdle muscular dystrophy type 1A comprising administering a recombinant adeno-associated virus comprising the MYOT miRNA-encoding DNA set out in SEQ ID NO: 2, 11286, 11287 or 11288, wherein the recombinant adeno-associated virus lacks rep and cap genes.

9. The method of any one of claims 6-8 wherein expression of the miRNA-encoding DNA is under the control of a CMV promoter, a muscle creatine kinase (MCK) promoter, an alpha-myosin heavy chain enhancer-/MCK enhancer-promoter (MHCK7) or a desmin promoter.

10. The method of any one of claims 6-8 wherein the recombinant adeno-associated virus is a self-complementary AAV-6.

11. A recombinant adeno-associated virus encoding an MYOT miRNA comprising an antisense guide strand set out SEQ ID NO: 7592, 7736, 7767, 7875, 8843 or 8874, wherein the recombinant adeno-associated virus lacks rep and cap genes.

12. A composition comprising the recombinant adeno-associated virus of claim 11 and a pharmaceutically acceptable carrier.

13. The recombinant adeno-associated virus of claim 11 wherein expression of the miRNA-encoding DNA is under the control of a CMV promoter, a muscle creatine kinase (MCK) promoter, an alpha-myosin heavy chain enhancer-/MCK enhancer-promoter (MHCK7) or a desmin promoter.

14. The recombinant adeno-associated virus of claim 11 that is a recombinant AAV-6.

15. The recombinant adeno-associated virus of claim 14 that is a self-complementary AAV-6.

16. A method of inhibiting expression of the MYOT gene in a cell comprising contacting the cell with a recombinant adeno-associated virus of claim 11, wherein the recombinant adeno-associated virus lacks rep and cap genes.

17. A method of delivering a MYOT miRNA-encoding DNA to an animal in need thereof, comprising administering to the animal a recombinant adeno-associated virus encoding an MYOT miRNA comprising an antisense guide strand set out in one of SEQ ID NO: 7592, 7736, 7767, 7875, 8843 or 8874, wherein the recombinant adeno-associated virus lacks rep and cap genes.

18. A method of treating limb girdle muscular dystrophy type 1A comprising administering a recombinant adeno-associated virus encoding an MYOT miRNA comprising an antisense guide strand set out in one of SEQ ID NO: 7592, 7736, 7767, 7875, 8843 or 8874, wherein the recombinant adeno-associated virus lacks rep and cap genes.

19. The method of any one of claims 16-18 wherein the recombinant adeno-associated virus is a self-complementary AAV-6.

20. The method of claim 9 wherein the recombinant adeno-associated virus is a self-complementary AAV-6.

* * * * *